United States Patent
Ciaramella et al.

(10) Patent No.: US 10,493,143 B2
(45) Date of Patent: *Dec. 3, 2019

(54) SEXUALLY TRANSMITTED DISEASE VACCINES

(71) Applicant: ModernaTX, Inc., Cambridge, MA (US)

(72) Inventors: Giuseppe Ciaramella, Sudbury, MA (US); Sunny Himansu, Winchester, MA (US)

(73) Assignee: ModernaTX, Inc., Cambridge, MA (US)

(*) Notice: Subject to any disclaimer, the term of this patent is extended or adjusted under 35 U.S.C. 154(b) by 0 days.

This patent is subject to a terminal disclaimer.

(21) Appl. No.: 16/023,013

(22) Filed: Jun. 29, 2018

(65) Prior Publication Data

US 2018/0296662 A1 Oct. 18, 2018

Related U.S. Application Data

(63) Continuation of application No. 15/767,600, filed as application No. PCT/US2016/058314 on Oct. 21, 2016.

(60) Provisional application No. 62/247,374, filed on Oct. 28, 2015, provisional application No. 62/247,418, filed on Oct. 28, 2015, provisional application No. 62/244,822, filed on Oct. 22, 2015, provisional application No. 62/244,884, filed on Oct. 22, 2015, provisional application No. 62/245,031, filed on Oct. 22, 2015.

(51) Int. Cl.
| | |
|---|---|
| *A61K 39/12* | (2006.01) |
| *A61K 39/118* | (2006.01) |
| *A61K 39/245* | (2006.01) |
| *B82Y 5/00* | (2011.01) |
| *A61K 9/00* | (2006.01) |
| *A61K 9/51* | (2006.01) |
| *C12N 7/00* | (2006.01) |
| *A61K 39/00* | (2006.01) |

(52) U.S. Cl.
CPC ............ *A61K 39/12* (2013.01); *A61K 9/0019* (2013.01); *A61K 9/5123* (2013.01); *A61K 39/118* (2013.01); *A61K 39/245* (2013.01); *C12N 7/00* (2013.01); *A61K 2039/53* (2013.01); *A61K 2039/545* (2013.01); *A61K 2039/55555* (2013.01); *A61K 2039/70* (2013.01); *B82Y 5/00* (2013.01); *C12N 2710/20034* (2013.01); *C12N 2710/20071* (2013.01); *Y02A 50/39* (2018.01)

(58) Field of Classification Search
None
See application file for complete search history.

(56) References Cited

U.S. PATENT DOCUMENTS

| | | |
|---|---|---|
| 6,500,419 B1 | 12/2002 | Hone et al. |
| 6,514,948 B1 | 2/2003 | Raz et al. |
| 6,610,044 B2 | 8/2003 | Mathiesen |
| 7,001,890 B1 | 2/2006 | Wagner et al. |
| 8,569,256 B2 | 10/2013 | Heyes et al. |
| 8,609,142 B2 | 12/2013 | Troiano et al. |
| 8,613,954 B2 | 12/2013 | Zale et al. |
| 8,617,608 B2 | 12/2013 | Zale et al. |
| 8,710,200 B2 | 4/2014 | Schrum et al. |
| 8,734,832 B2 | 5/2014 | O'Hagan et al. |
| 8,734,853 B2 | 5/2014 | Sood et al. |
| 8,754,062 B2 | 6/2014 | De Fougerolles et al. |
| 8,822,663 B2 | 9/2014 | Schrum et al. |
| 8,999,380 B2 | 4/2015 | Bancel et al. |
| 9,221,891 B2 | 12/2015 | Bancel et al. |
| 9,303,079 B2 | 4/2016 | Bancel et al. |
| 9,464,124 B2 | 10/2016 | Bancel et al. |
| 9,512,456 B2 | 12/2016 | Wang et al. |
| 9,597,380 B2 | 3/2017 | Chakraborty et al. |
| 9,745,351 B2 * | 8/2017 | Li .................... A61K 39/12 |
| 9,868,691 B2 | 1/2018 | Benenato et al. |
| 9,872,900 B2 | 1/2018 | Ciaramella et al. |
| 10,064,934 B2 | 9/2018 | Ciaramella et al. |
| 10,064,935 B2 | 9/2018 | Ciaramella et al. |
| 10,124,055 B2 | 11/2018 | Ciaramella et al. |
| 2001/0001066 A1 | 5/2001 | Cezayirli et al. |
| 2003/0032615 A1 | 2/2003 | Felgner et al. |
| 2005/0032730 A1 | 2/2005 | Von Der Mulbe et al. |
| 2005/0059624 A1 | 3/2005 | Hoerr et al. |
| 2005/0250723 A1 | 11/2005 | Hoerr et al. |
| 2006/0172003 A1 | 8/2006 | Meers et al. |
| 2006/0172966 A1 | 8/2006 | Lipford et al. |
| 2007/0280929 A1 | 12/2007 | Hoerr et al. |

(Continued)

FOREIGN PATENT DOCUMENTS

| | | |
|---|---|---|
| AU | 652831 B2 | 9/1994 |
| CA | 2473135 A1 | 6/2003 |

(Continued)

OTHER PUBLICATIONS

Cheng et al. Enhancement of Sindbis Virus Self-Replicating RNA Vaccine Potency by Targeting Antigen to Endosomal/Lysosomal Compartments. Human Gene Therapy, 12: 235-253 (Feb. 10, 2001).*

(Continued)

*Primary Examiner* — Nianxiang Zou
(74) *Attorney, Agent, or Firm* — Wolf, Greenfield & Sacks, P.C.

(57) ABSTRACT

The disclosure relates to sexually transmitted disease ribonucleic acid vaccines and combination vaccines, as well as methods of using the vaccines and compositions comprising the vaccines.

19 Claims, 2 Drawing Sheets

Specification includes a Sequence Listing.

(56) References Cited

U.S. PATENT DOCUMENTS

| | | |
|---|---|---|
| 2010/0189729 A1 | 7/2010 | Hoerr et al. |
| 2010/0203076 A1 | 8/2010 | Fotin-Mleczek et al. |
| 2010/0239608 A1 | 9/2010 | Von Der Mulbe et al. |
| 2010/0303851 A1 | 12/2010 | Hoerr et al. |
| 2011/0250225 A1 | 10/2011 | Fotin-Mleczek et al. |
| 2011/0269950 A1 | 11/2011 | Von Der Mulbe et al. |
| 2011/0311472 A1 | 12/2011 | Hoerr et al. |
| 2012/0107350 A1 | 5/2012 | Xu et al. |
| 2012/0189700 A1 | 7/2012 | Aguilar et al. |
| 2012/0258046 A1 | 10/2012 | Mutske |
| 2013/0102034 A1 | 4/2013 | Schrum et al. |
| 2013/0121988 A1 | 5/2013 | Hoerr et al. |
| 2013/0123481 A1* | 5/2013 | de Fougerolles ...... C07H 21/02 536/23.1 |
| 2013/0142818 A1 | 6/2013 | Baumhof et al. |
| 2013/0171241 A1 | 7/2013 | Geall |
| 2013/0183355 A1 | 7/2013 | Jain et al. |
| 2013/0189351 A1 | 7/2013 | Geall |
| 2013/0195867 A1 | 8/2013 | Hoerr et al. |
| 2013/0195968 A1 | 8/2013 | Geall et al. |
| 2013/0195969 A1 | 8/2013 | Geall et al. |
| 2013/0202684 A1 | 8/2013 | Geall et al. |
| 2013/0236533 A1 | 9/2013 | Von Andrian et al. |
| 2013/0259923 A1 | 10/2013 | Bancel et al. |
| 2013/0266640 A1 | 10/2013 | De Fougerolles et al. |
| 2013/0295043 A1* | 11/2013 | Kallen ................ A61K 39/00 424/85.2 |
| 2013/0336998 A1 | 12/2013 | Kallen et al. |
| 2014/0065228 A1 | 3/2014 | Yarowoski et al. |
| 2014/0134201 A1 | 5/2014 | Tureci et al. |
| 2014/0147432 A1 | 5/2014 | Bancel et al. |
| 2014/0148502 A1 | 5/2014 | Bancel et al. |
| 2014/0193482 A1 | 7/2014 | Bancel et al. |
| 2014/0206752 A1 | 7/2014 | Afeyan et al. |
| 2014/0271829 A1 | 9/2014 | Lilja et al. |
| 2014/0378538 A1 | 12/2014 | Bancel |
| 2015/0141499 A1 | 5/2015 | Bancel et al. |
| 2015/0307542 A1 | 10/2015 | Roy et al. |
| 2015/0315541 A1 | 11/2015 | Bancel et al. |
| 2016/0024141 A1 | 1/2016 | Issa et al. |
| 2016/0032273 A1 | 2/2016 | Shahrokh et al. |
| 2016/0038612 A1 | 2/2016 | Hoge et al. |
| 2016/0317647 A1 | 11/2016 | Ciaramella et al. |
| 2016/0331844 A1 | 11/2016 | Fotin-Mleczek et al. |
| 2017/0202979 A1 | 7/2017 | Chakraborty et al. |
| 2017/0340724 A1 | 11/2017 | Ciaramella et al. |
| 2018/0002393 A1 | 1/2018 | Bancel et al. |
| 2018/0028664 A1 | 2/2018 | Besin et al. |
| 2018/0237849 A1 | 8/2018 | Thompson |
| 2018/0243225 A1 | 8/2018 | Ciaramella |
| 2018/0243230 A1 | 8/2018 | Smith |
| 2018/0271970 A1 | 9/2018 | Ciaramella et al. |
| 2018/0273977 A1 | 9/2018 | Mousavi et al. |
| 2018/0274009 A1 | 9/2018 | Marquardt et al. |
| 2018/0280496 A1 | 10/2018 | Ciaramella et al. |
| 2018/0289792 A1 | 10/2018 | Ciaramella et al. |
| 2018/0303925 A1* | 10/2018 | Weissman ............... A61P 31/18 |
| 2018/0303929 A1 | 10/2018 | Ciaramella et al. |
| 2018/0311336 A1 | 11/2018 | Ciaramella et al. |
| 2018/0312549 A1 | 11/2018 | Ciaramella |
| 2018/0318409 A1 | 11/2018 | Valiante et al. |
| 2018/0363019 A1 | 12/2018 | Hoge |
| 2019/0008938 A1 | 1/2019 | Ciaramella et al. |

FOREIGN PATENT DOCUMENTS

| | | | |
|---|---|---|---|
| CA | 2901501 A1 | 8/2014 | |
| EP | 1083232 B1 | 2/2005 | |
| EP | 1301614 B1 | 11/2006 | |
| EP | 1383556 B1 | 10/2007 | |
| EP | 1905844 A2 | 2/2008 | |
| EP | 1026253 B2 | 12/2012 | |
| EP | 2188379 B1 | 1/2013 | |
| WO | WO 1990/011092 A1 | 10/1990 | |
| WO | WO 1999/052503 A2 | 10/1999 | |
| WO | WO 2001/021810 A1 | 3/2001 | |
| WO | WO 2002/006113 A2 | 8/2002 | |
| WO | WO 2004/058166 A2 | 7/2004 | |
| WO | WO 2005/007689 A1 | 1/2005 | |
| WO | WO 2008/014979 A3 | 2/2008 | |
| WO | WO 2008/052770 A2 | 5/2008 | |
| WO | WO 2008/083949 A2 | 7/2008 | |
| WO | WO 2010/037408 A1 | 4/2010 | |
| WO | WO 2010/037539 A1 | 4/2010 | |
| WO | WO 2010/042877 A1 | 4/2010 | |
| WO | WO 2010/054406 A1 | 5/2010 | |
| WO | WO 2010/088927 A1 | 8/2010 | |
| WO | WO 2010/115046 A2 | 10/2010 | |
| WO | WO 2011/005799 A2 | 1/2011 | |
| WO | WO 2011/069529 A1 | 6/2011 | |
| WO | WO 2011/069586 A1 | 6/2011 | |
| WO | WO 2011/144358 A1 | 11/2011 | |
| WO | WO 2012/006369 A2 | 1/2012 | |
| WO | WO 2012/006380 A2 | 1/2012 | |
| WO | WO 2012/019630 A1 | 2/2012 | |
| WO | WO 2012/019780 A1 | 2/2012 | |
| WO | WO 2012/075040 A2 | 6/2012 | |
| WO | WO 2012/089225 A1 | 7/2012 | |
| WO | WO 2012/113513 A1 | 8/2012 | |
| WO | WO 2012/116714 A1 | 9/2012 | |
| WO | WO 2012/116715 A1 | 9/2012 | |
| WO | WO 2012/116810 A1 | 9/2012 | |
| WO | WO 2012/116811 A1 | 9/2012 | |
| WO | WO 2013/006837 A1 | 1/2013 | |
| WO | WO 2013/006838 A1 | 1/2013 | |
| WO | WO 2013/006842 A2 | 1/2013 | |
| WO | WO 2013/030778 A2 | 3/2013 | |
| WO | WO 2013/052167 A2 | 4/2013 | |
| WO | WO 2013/056132 A2 | 4/2013 | |
| WO | WO 2013/059496 A1 | 4/2013 | |
| WO | WO 2013/113502 A1 | 8/2013 | |
| WO | WO 2013/174409 A1 | 11/2013 | |
| WO | WO 2014/071963 A1 | 5/2014 | |
| WO | WO 2014/072061 A1 | 5/2014 | |
| WO | WO 2014/127917 A1 | 8/2014 | |
| WO | WO 2014/160243 A1 | 10/2014 | |
| WO | WO 2015/013551 A1 | 1/2015 | |
| WO | WO 2015/024667 A1 | 2/2015 | |
| WO | WO 2015/024668 A2 | 2/2015 | |
| WO | WO 2015/130584 A2 | 9/2015 | |
| WO | WO 2015/189425 A1 | 12/2015 | |
| WO | WO 2016/164762 A1 | 10/2016 | |
| WO | WO 2016/170176 A | 10/2016 | |
| WO | WO 2016/176330 A1 | 11/2016 | |
| WO | WO 2016/198531 A2 | 12/2016 | |
| WO | WO 2016/201377 A1 | 12/2016 | |
| WO | WO 2016/203025 A1 | 12/2016 | |
| WO | WO 2017/015457 A1 | 1/2017 | |
| WO | WO 2017/015463 A1 | 1/2017 | |
| WO | WO 2017/019935 A1 | 2/2017 | |
| WO | WO 2017/020026 A1 | 2/2017 | |
| WO | WO 2017/031232 A1 | 2/2017 | |
| WO | WO 2017/031241 A1 | 2/2017 | |
| WO | WO 2017/062513 A1 | 4/2017 | |
| WO | WO 2017/066789 A1 | 4/2017 | |
| WO | WO 2017/070601 A1 | 4/2017 | |
| WO | WO 2017/070616 A1 | 4/2017 | |
| WO | WO 2017/070618 A1 | 4/2017 | |
| WO | WO 2017/070620 A1 | 4/2017 | |
| WO | WO 2017/070622 A1 | 4/2017 | |
| WO | WO 2017/070623 A1 | 4/2017 | |
| WO | WO 2017/201333 A1 | 11/2017 | |
| WO | WO 2017/201340 A1 | 11/2017 | |
| WO | WO 2017/201342 A1 | 11/2017 | |
| WO | WO 2017/201347 A1 | 11/2017 | |
| WO | WO 2018/053209 A1 | 3/2018 | |
| WO | WO 2018/075980 A1 | 4/2018 | |
| WO | WO 2018/078053 A1 | 5/2018 | |
| WO | WO 2018/081459 A1 | 5/2018 | |
| WO | WO 2018/081462 A1 | 5/2018 | |
| WO | WO 2018/089851 A1 | 5/2018 | |
| WO | WO 2018/107088 A1 | 6/2018 | |
| WO | WO 2018/111967 A1 | 6/2018 | |

(56) References Cited

FOREIGN PATENT DOCUMENTS

| WO | WO 2018/144082 A1 | 8/2018 |
|---|---|---|
| WO | WO 2018/144778 A1 | 8/2018 |
| WO | WO 2018/151816 A1 | 8/2018 |
| WO | WO 2018/170245 A1 | 9/2018 |
| WO | WO 2018/170256 A1 | 9/2018 |
| WO | WO 2018/170260 A1 | 9/2018 |
| WO | WO 2018/170270 A1 | 9/2018 |
| WO | WO 2018/170347 A1 | 9/2018 |
| WO | WO 2018/175783 A1 | 9/2018 |
| WO | WO 2018/187590 A2 | 10/2018 |
| WO | WO 2018/200737 A1 | 11/2018 |
| WO | WO 2018/232355 A1 | 12/2018 |
| WO | WO 2018/232357 A1 | 12/2018 |

OTHER PUBLICATIONS

Geall et al. Nonviral delivery of self-amplifying RNA vaccines. PNAS, 109(36): 14604-14609 (Sep. 4, 2012).*

Cantarella et al. Recombinant measles virus-HPV vaccine candidates for prevention of cervical carcinoma. Vaccine 27 (2009) 3385-3390.*

Anderson et al., Incorporation of pseudouridine into mRNA enhances translation by diminishing PKR activation, Nucleic Acids Res. Sep. 2010;38(17):5884-92. doi: 10.1093/nar/gkq347. Epub May 10, 2010.

Bahl et al., Preclinical and Clinical Demonstration of Immunogenicity by mRNA Vaccines against H10N8 and H7N9 Influenza Viruses. Mol Ther. Jun. 7, 2017;25(6):1316-1327. doi: 10.1016/j.ymthe.2017.03.035. Epub Apr. 27, 2017.

Bogers et al., Potent immune responses in rhesus macaques induced by nonviral delivery of a self-amplifying RNA vaccine expressing HIV type 1 envelope with a cationic nanoemulsion.J Infect Dis. Mar. 15, 2015;211(6):947-55. doi: 10.1093/infdis/jiu522. Epub Sep. 18, 2014.

Brito et al., A cationic nanoemulsion for the delivery of next-generation RNA vaccines. Mol Ther. Dec. 2014;22(12):2118-29. doi: 10.1038/mt.2014.133. Epub Jul. 16, 2004.

Cheng et al., Multifunctional triblock copolymers for intracellular messenger RNA delivery. Biomaterials. Oct. 2012; 33(28): 6868-6876.

Cu et al., Enhanced Delivery and Potency of Self-Amplifying mRNA Vaccines by Electroporation in Situ, Vaccines, 2013, 1, 367-383. Abstract Only.

Deering et al., Nucleic acid vaccines: prospects for non-viral delivery of mRNA vaccines.Expert Opin Drug Deliv. Jun. 2014;11(6):885-99. doi: 10.1517/17425247.2014.901308. Epub Mar. 26, 2014.

Dicaro et al., In Vivo Delivery of Nucleic Acid-Formulated Microparticles as a Potential Tolerogenic Vaccine for Type 1 Diabetes. Rev Diabet Stud. 2012 Winter;9(4):348-56.

Diken et al., Current Developments in Actively Personalized Cancer Vaccination with a Focus on RNA as the Drug Format. Prog Tumor Res. 2015;42:44-54. doi: 10.1159/000437184. Epub Sep. 4, 2015. Review.

Fleeton et al., Self-replicative RNA vaccines elicit protection against influenza A virus, respiratory syncytial virus, and a tickborne encephalitis virus. J Infect Dis. May 1, 2001;183(9):1395-8. Epub Mar. 30, 2001.

Geall et al., Nonviral delivery of self-amplifying RNA vaccines. Proc Natl Acad Sci U S A. Sep. 4, 2012;109(36):14604-9. doi:10.1073/pnas.1209367109. Epub Aug. 20, 2012.

Herds et al., Recombinant Kunjin virus replicon vaccines induce protective T-cell immunity against human papillomavirus 16 E7-expressing tumour. Virology. Feb. 20, 2004;319(2):237-48.

Holtkamp et al., Modification of antigen-encoding RNA increases stability, translational efficacy, and T-cell stimulatory capacity of dendritic cells. Blood. Dec. 15, 2006;108(13):4009-17.

Kallen et al., A development that may evolve into a revolution in medicine: mRNA as the basis for novel, nucleotide-based vaccines and drugs. Ther Adv Vaccines. Jan. 2014;2(1):10-31. doi: 10.1177/2051013613508729.

Kauffman et al., Efficacy and immunogenicity of unmodified and pseudouridine-modified mRNA delivered systemically with lipid nanoparticles in vivo. Biomaterials. Dec. 2016;109:78-87. doi: 10.1016/j.biomaterials.2016.09.006. Epub Sep. 25, 2016.

Kuhn et al., mRNA as a versatile tool for exogenous protein expression. Current Gene Therapy. Oct. 2012; 12 (5): 347-361.

Leitner et al., DNA and RNA-based vaccines: principles, progress and prospects. Vaccine. Dec. 10, 1999;18 (9-10):765-77.

Lian et al., Trends and developments in liposome drug delivery systems. J Pharm Sci. Jun. 2001;90(6):667-80.

Liang et al., Efficient Targeting and Activation of Antigen-Presenting Cells In Vivo after Modified mRNA Vaccine Administration in Rhesus Macaques. Mol Ther. Dec. 6, 2017;25(12):2635-2647. doi: 10.1016/j.ymthe.2017.08.006. Epub Aug. 12, 2017.

Lindgren et al., Induction of Robust B Cell Responses after Influenza mRNA Vaccination is Accompanied by Circulating Hemagglutinin-Specific ICOS+ PD-1+ CXCR3+ T Follicular Helper Cells. Front Immunol. Nov. 13, 2017;8:1539. doi: 10.3389/fimmu.2017.01539. eCollection 2017.

Lorenzi et al., Intranasal vaccination with messenger RNA as a new approach in gene therapy: Use against tuberculosis. BMC Biotechnol. Oct. 2010; 10(77): 1-11.

MacLachlan, Lipid Nanoparticle-mediated delivery of messenger RNA. Presentation. 1st International mRNA Health Conference. Tubingen, Germany. Oct. 24, 2013. http://files.shareholder.com/downloads/ABEA-50QJTB/2628241206x0x699789/47543d12-db34-4e6e-88a9-f3ae5d97b1d2/MacLachlan_mRNA_Conf_2013.pdf. Last accessed Dec. 22, 2016.

Madden et al., Systemic delivery of mRNA therapeutics using lipid nanoparticles (LNP): improved potency for novel LNP and influence of route of administration on protein expression. 2nd International mRNA Health Conference. Nov. 12, 2014. https://acuitastx.com/wp-content/uploads/2015/01/Poster-Second-International-mRNA-Health-Conference.pdf. 1 page.

Martinon et al., Induction of virus-specific cytotoxic T lymphocytes in vivo by liposome-entrapped mRNA. EurJ lmmunol. Jul. 1993;23(7):1719-22.

McKenzie et al., Nucleic acid vaccines: tasks and tactics. lmmunol Res. 2001 ;24(3):225-44.

Midoux et al., Lipid-based mRNA vaccine delivery systems. Expert Rev Vaccines. Feb. 2015;14(2):221-34. doi: 10.1586/14760584. 2015.986104. Epub Dec. 26, 2014. Review.

Mitchell et al., RNA transfected dendritic cells as cancer vaccines. Curr Opin Mol Ther. Apr. 2000;2(2):176-81.

Mockey et al., mRNA-based cancer vaccine: prevention of B16 melanoma progression and metastasis by systemic injection of MART1 mRNA histidylated lipopolyplexes. Cancer Gene Ther. Sep. 2007;14(9):802-14. Epub Jun. 22, 2007.

Petsch et al., Protective efficacy of in vitro synthesized, specific mRNA vaccines against influenza A virus infection. Nat Biotechnol. Dec. 2012;30(12):1210-6. doi: 10.1038/nbt.2436. Epub Nov. 25, 2012.

Pollard et al., Type I IFN counteracts the induction of antigen-specific immune responses by lipid-based delivery of mRNA vaccines. Mol Ther. Jan. 2013; 21 (1): 251-259.

Schirrmacher et al., Intra-pinna anti-tumor vaccination with self-replicating infectious RNA or with DNA encoding a model tumor antigen and a cytokine. Gene Ther. Jul. 2000;7(13):1137-47.

Schott et al., Viral and non-viral approaches for transient delivery of mRNA and proteins. Current Gene Ther. 2011; 11 (5): 382-398.

Thess et al., Sequence-engineered mRNA Without Chemical Nucleoside Modifications Enables an Effective Protein Therapy in Large Animals. Mol Ther. Sep. 2015;23(9):1456-64. doi: 10.1038/mt.2015.103. Epub Jun. 8, 2015.

Vassilev et al., Microparticle-mediated RNA immunization against bovine viral diarrhea virus. Vaccine. Feb. 28, 2001;19(15-16):2012-9.

Vici et al., Immunologic treatments for precancerous lesions and uterine cervical cancer. J Exp Clin Cancer Res. Mar. 26, 2014;33:29. doi: 10.1186/1756-9966-33-29.

(56) References Cited

OTHER PUBLICATIONS

Wang et al., Systemic delivery of modified mRNA encoding herpes simplex virus 1 thymidine kinase for targeted cancer gene therapy. Mol Ther. Feb. 2013;21(2):358-67. doi: 10.1038/mt.2012.250. Epub Dec. 11, 2012.

Weilhammer et al., the use of nanolipoprotein particles to enhance the immunostimulatory properties of innate immune agonists against lethal influenza challenge. Biomaterials. Dec. 2013;34(38):10305-18. doi: 10.1016/j.biomaterials.2013.09.038. Epub Sep. 27, 2013.

Wong et al., An mRNA vaccine for influenza. Nat Biotechnol. Dec. 2012;30(12):1202-4. doi: 10.1038/nbt.2439.

Yamamoto et al., Current prospects for mRNA gene delivery. Eur J Pharm Biopharm. Mar. 2009;71(3):484-9. doi: 10.1016/j.ejpb.2008.09.016. Epub Oct. 10, 2008.

Ying et al., Cancer therapy using a self-replicating RNA vaccine. Nat Med. Jul. 1999;5(7):823-7.

Blenke, Intracellular delivery of RNA therapeutics with lipid nanoparticles. Publicly available on Jan. 25, 2017. Department of Pharmaceutics, Utrecht Institute for Pharmaceutical Sciences, Faculty of Science, University of Utrecht, Netherlands.

\* cited by examiner

SEXUALLY TRANSMITTED DISEASE VACCINES

RELATED APPLICATIONS

This application is a continuation of U.S. application Ser. No. 15/767,600, filed Apr. 11, 2018, which is a national stage filing under 35 U.S.C. § 371 of international patent application number PCT/US2016/058314, filed Oct. 21, 2016, which claims the benefit under 35 U.S.C. § 119(e) of U.S. provisional application No. 62/244,884, filed Oct. 22, 2015, U.S. provisional application No. 62/247,418, filed Oct. 28, 2015, U.S. provisional application No. 62/244,822, filed Oct. 22, 2015, and U.S. provisional application No. 62/247,374, filed Oct. 28, 2015, each of which is incorporated by reference herein in its entirety. This application also claims the benefit under 35 U.S.C. § 119(e) of U.S. provisional application No. 62/245,031, filed Oct. 22, 2015, which is incorporated by reference herein in its entirety.

BACKGROUND

Sexually transmitted diseases (STDs) are a major global cause of acute illness, infertility, long-term disability, and death, with severe medical and psychological consequences for millions of men, women, and children (Hafner L. et al. *Mucosal Immunology* (2008) 1, 116-130).

Human papillomavirus (HPV) is a group of over 170 small DNA viruses from the papillomavirus family. It is the most commonly sexually transmitted infection, and while most HPV infections are subclinical, HPV is an etiological agent for cervical cancer, the second greatest cause of mortality among cancer-affected women worldwide. HPV-associated cancers account for over 5% of the total diagnosed cancer cases internationally, and the incidence is higher in developing countries, where HPV is estimated to cause about 500,000 cases annually. The high levels of HPV exposure and health consequences indicate the importance of developing safe vaccine candidates against HPV.

*Chlamydia* infection is caused by the *Chlamydia trachomatis* (*C. trachomatis*) bacterium. It is one of the most commonly sexually transmitted infections worldwide, affecting approximately 215 million people internationally. In the United States, there are around 2.8 million new cases of *Chlamydia* each year. *Chlamydia trachomatis* can also cause *Chlamydia* conjunctivitis or trachoma, a disease that can result in blindness. Worldwide, approximately 80 million people have active infections, resulting in impaired vision and blindness for nearly 2.2 million individuals. The international health consequences associated with *Chlamydia* exemplify the importance of developing effective and safe vaccine candidates against *Chlamydia*.

Herpes simplex viruses (HSV) are double-stranded linear DNA viruses in the Herpesviridae family. Two members of the herpes simplex virus family infect humans—known as HSV-1 and HSV-2. Symptoms of HSV infection include the formation of blisters in the skin or mucous membranes of the mouth, lips, and/or genitals. HSV is a neuroinvasive virus that can cause sporadic recurring episodes of viral reactivation in infected individuals. HSV is transmitted by contact with an infected area of the skin during a period of viral activation.

Deoxyribonucleic acid (DNA) vaccination is one technique used to stimulate humoral and cellular immune responses to foreign antigens, such as HPV antigens, HSV antigens and/or *Chlamydia* antigens. The direct injection of genetically engineered DNA (e.g., naked plasmid DNA) into a living host results in a small number of its cells directly producing an antigen, resulting in a protective immunological response. With this technique, however, comes potential problems, including the possibility of insertional mutagenesis, which could lead to the activation of oncogenes or the inhibition of tumor suppressor genes.

SUMMARY

Provided herein are ribonucleic acid (RNA) vaccines that build on the knowledge that RNA (e.g., messenger RNA (mRNA)) can safely direct the body's cellular machinery to produce nearly any protein of interest, from native proteins to antibodies and other entirely novel protein constructs that can have therapeutic activity inside and outside of cells. The RNA (e.g., mRNA) vaccines of the present disclosure may be used to induce a balanced immune response against HPV, HSV and/or *Chlamydia* (e.g., *C. trachomatis*), comprising both cellular and humoral immunity, without risking the possibility of insertional mutagenesis, for example. HPV, HSV and/or *Chlamydia* are referred to herein as "sexually transmitted diseases (STDs)." Thus, the term "STD RNA vaccines" and "HPV, HSV and/or *Chlamydia*" encompasses HPV RNA vaccines, HSV RNA vaccines, *Chlamydia* RNA vaccines, and combination vaccines comprising: at least one HPV RNA vaccine and at least one HSV RNA vaccine; at least one HPV RNA vaccine and at least one *Chlamydia* RNA vaccine, at least one HSV vaccine and at least one *Chlamydia* RNA vaccine; and at least one HPV RNA vaccine, at least one HSV RNA vaccine and at least one *Chlamydia* RNA vaccine.

The RNA (e.g., mRNA) vaccines may be utilized in various settings depending on the prevalence of the infection or the degree or level of unmet medical need. The RNA (e.g. mRNA) vaccines may be utilized to treat and/or prevent HPV, HSV and/or *Chlamydia* of various genotypes, strains, and isolates. The RNA (e.g., mRNA) vaccines have superior properties in that they produce much larger antibody titers and produce responses earlier than commercially available anti-viral therapeutic treatments. While not wishing to be bound by theory, it is believed that the RNA (e.g., mRNA) vaccines, as mRNA polynucleotides, are better designed to produce the appropriate protein conformation upon translation as the RNA (e.g., mRNA) vaccines co-opt natural cellular machinery. Unlike traditional vaccines, which are manufactured ex vivo and may trigger unwanted cellular responses, RNA (e.g., mRNA) vaccines are presented to the cellular system in a more native fashion.

Surprisingly, it has been shown that efficacy of mRNA vaccines can be significantly enhanced when combined with a flagellin adjuvant, in particular, when one or more antigen-encoding mRNAs is combined with an mRNA encoding flagellin. RNA (e.g., mRNA) vaccines combined with the flagellin adjuvant (e.g., mRNA-encoded flagellin adjuvant) have superior properties in that they may produce much larger antibody titers and produce responses earlier than commercially available vaccine formulations.

Some embodiments of the present disclosure provide RNA (e.g., mRNA) vaccines that include at least one RNA (e.g., mRNA) polynucleotide having an open reading frame encoding at least one antigenic polypeptide or an immunogenic fragment thereof (e.g., an immunogenic fragment capable of inducing an immune response to the antigenic polypeptide) and at least one RNA (e.g., mRNA polynucleotide) having an open reading frame encoding a flagellin adjuvant.

In some embodiments, at least one flagellin polypeptide (e.g., encoded flagellin polypeptide) is a flagellin protein. In some embodiments, at least one flagellin polypeptide (e.g., encoded flagellin polypeptide) is an immunogenic flagellin fragment. In some embodiments, at least one flagellin polypeptide and at least one antigenic polypeptide are encoded by a single RNA (e.g., mRNA) polynucleotide. In other embodiments, at least one flagellin polypeptide and at least one antigenic polypeptide are each encoded by a different RNA polynucleotide.

In some embodiments at least one flagellin polypeptide has at least 80%, at least 85%, at least 90%, or at least 95% identity to a flagellin polypeptide having a sequence of SEQ ID NO: 301-303.

Provided herein, in some embodiments, is a ribonucleic acid (RNA) (e.g., mRNA) vaccine, comprising at least one (e.g., at least 2, 3, 4 or 5) RNA (e.g., mRNA) polynucleotide having an open reading frame encoding at least one (e.g., at least 2, 3, 4 or 5) HPV, HSV and/or *Chlamydia* (e.g., *C. trachomatis*) antigenic polypeptide, or any combination of two or more of the foregoing antigenic polypeptides. Herein, use of the term "antigenic polypeptide" encompasses immunogenic fragments of the antigenic polypeptide (an immunogenic fragment that induces (or is capable of inducing) an immune response to HPV, HSV and/or *Chlamydia* (e.g., *C. trachomatis*), unless otherwise stated.

Also provided herein, in some embodiments, is a RNA (e.g., mRNA) vaccine comprising at least one (e.g., at least 2, 3, 4 or 5) RNA polynucleotide having an open reading frame encoding at least one (e.g., at least 2, 3, 4 or 5) HPV, HSV and/or *Chlamydia* (e.g., *C. trachomatis*) antigenic polypeptide or an immunogenic fragment thereof, linked to a signal peptide.

Further provided herein, in some embodiments, is a nucleic acid (e.g., DNA) encoding at least one (e.g., at least 2, 3, 4 or 5) HPV, HSV and/or *Chlamydia* (e.g., *C. trachomatis*) RNA (e.g., mRNA) polynucleotide.

Further still, provided herein, in some embodiments, is a method of inducing an immune response in a subject, the method comprising administering to the subject a vaccine comprising at least one (e.g., at least 2, 3, 4 or 5) RNA (e.g., mRNA) polynucleotide having an open reading frame encoding at least one (e.g., at least 2, 3, 4 or 5) HPV, HSV and/or *Chlamydia* (e.g., *C. trachomatis*) antigenic polypeptide, or any combination of two or more of the foregoing antigenic polypeptides.

HPV

In some embodiments, a RNA (e.g., mRNA) vaccine comprises at least one RNA (e.g., mRNA) polynucleotide having an open reading frame encoding at least one HPV antigenic polypeptide or an immunogenic fragment thereof (e.g., an immunogenic fragment capable of inducing an immune response to HPV). In some embodiments, at least one antigenic polypeptide is selected from E1, E2, E4, E5, E6, E7, L1, and L2. In some embodiments, the at least one antigenic polypeptide is selected from E1, E2, E4, E5, E6, and E7. In some embodiments, the at least one antigenic polypeptide is E6, E7, or a combination of E6 and E7. In some embodiments, the at least one antigenic polypeptide is L1, L2, or a combination of L1 and L2.

In some embodiments, the at least one antigenic polypeptide is L1. In some embodiments, the L1 protein is obtained from HPV serotypes 6, 11, 16, 18, 31, 33, 35, 39, 45, 51, 52, 56, 58, 59, 68, 73 or 82.

In some embodiments, the at least one antigenic polypeptide is L1, L2 or a combination of L1 and L2, and E6, E7, or a combination of E6 and E7.

In some embodiments, the at least one antigenic polypeptide is from HPV strain HPV type 16 (HPV16), HPV type 18 (HPV18), HPV type 26 (HPV26), HPV type 31 (HPV31), HPV type 33 (HPV33), HPV type 35 (HPV35), HPV type 45 (HPV45), HPV type 51 (HPV51), HPV type 52 (HPV52), HPV type 53 (HPV53), HPV type 56 (HPV56), HPV type 58 (HPV58), HPV type 59 (HPV59), HPV type 66 (HPV66), HPV type 68 (HPV68), HPV type 82 (HPV82), or a combination thereof. In some embodiments, the at least one antigenic polypeptide is from HPV strain HPV16, HPV18, or a combination thereof.

In some embodiments, the at least one antigenic polypeptide is from HPV strain HPV type 6 (HPV6), HPV type 11 (HPV11), HPV type 13 (HPV13), HPV type 40 (HPV40), HPV type 42 (HPV42), HPV type 43 (HPV43), HPV type 44 (HPV44), HPV type 54 (HPV54), HPV type 61 (HPV61), HPV type 70 (HPV70), HPV type 72 (HPV72), HPV type 81 (HPV81), HPV type 89 (HPV89), or a combination thereof.

In some embodiments, the at least one antigenic polypeptide is from HPV strain HPV type 30 (HPV30), HPV type 34 (HPV34), HPV type 55 (HPV55), HPV type 62 (HPV62), HPV type 64 (HPV64), HPV type 67 (HPV67), HPV type 69 (HPV69), HPV type 71 (HPV71), HPV type 73 (HPV73), HPV type 74 (HPV74), HPV type 83 (HPV83), HPV type 84 (HPV84), HPV type 85 (HPV85), or a combination thereof.

In some embodiments, a vaccine comprises at least one RNA (e.g., mRNA) polynucleotide having an open reading frame encoding at least one (e.g., one, two, three, four, five, six, seven, or eight) of E1, E2, E4, E5, E6, E7, L1, and L2 protein obtained from HPV, or a combination thereof. In some embodiments, a vaccine comprises at least one RNA (e.g., mRNA) polynucleotide having an open reading frame encoding at least one (e.g., one, two, three, four, five, or six) polypeptide selected from E1, E2, E4, E5, E6, and E7 protein obtained from HPV, or a combination thereof. In some embodiments a vaccine comprises at least one RNA (e.g., mRNA) polynucleotide having an open reading frame encoding at least one polypeptide selected from E6 and E7 protein obtained from HPV, or a combination thereof. In some embodiments, a vaccine comprises at least one RNA (e.g., mRNA) polynucleotide having an open reading frame encoding a polypeptide selected from L1 or L2 protein obtained from HPV, or a combination thereof.

In some embodiments, the at least one RNA polynucleotide encodes an antigenic polypeptide that structurally modifies an infected cell.

In some embodiments, the at least one RNA polynucleotide encodes an antigenic polypeptide that forms part or all of the HPV viral capsid.

In some embodiments, the at least one RNA polynucleotide encodes an antigenic polypeptide that is capable of self-assembling into virus-like particles.

In some embodiments, the at least one RNA polynucleotide encodes an antigenic polypeptide that is responsible for binding of the HPV to a cell being infected.

In some embodiments, the at least one RNA polynucleotide encodes an antigenic polypeptide that interacts with retinoblastoma protein (pRb). In some embodiments, the at least one RNA polynucleotide encodes an antigenic polypeptide that interacts with p53.

In some embodiments, at least one HPV antigenic polypeptide comprises an amino acid sequence of SEQ ID NO: 31-59 (Table 2). In some embodiments, the amino acid sequence of the HPV antigenic polypeptide is, or is a fragment of, or is a homolog or variant having at least 80% (e.g., 85%, 90%, 95%, 98%, 99%0) identity to, the amino acid sequence of SEQ ID NO: 31-59 (Table 2).

In some embodiments, at least one HPV antigenic polypeptide is encoded by a nucleic acid sequence identified by any one of SEQ ID NO: 1-28 (Table 1).

In some embodiments, at least one HPV RNA (e.g., mRNA) polynucleotide is encoded by a nucleic acid sequence, or a fragment of a nucleotide sequence, identified by any one of SEQ ID NO: 1-28 (Table 1).

In some embodiments, at least one HPV RNA (e.g., mRNA) polynucleotide comprises a nucleic acid sequence, or a fragment of a nucleotide sequence, identified by any one of SEQ ID NO: 431-461 (Table 1).

*Chlamydia*

In some embodiments, a RNA (e.g., mRNA) vaccine comprises at least one RNA (e.g., mRNA) polynucleotide having an open reading frame encoding at least one *Chlamydia* (e.g., *C. trachomatis*) antigenic polypeptide or an immunogenic fragment thereof (e.g., an immunogenic fragment capable of inducing an immune response to *Chlamydia*, e.g., *C. trachomatis*).

In some embodiments, at least one antigenic polypeptide is a major outer membrane protein (MOMP or OmpA) or an immunogenic fragment thereof. The MOMP may be from *Chlamydia trachomatis* serovar (serotype) H, F, E, D, I, G, J or K.

In some embodiments, at least one antigenic polypeptide is from a virulence related outer membrane protein family (such as OmpA, OmpL, OmpF, OprF) or an immunogenic fragment thereof. The OMP may be from *Chlamydia trachomatis* or any Gram negative bacteria (e.g., *Pseudomonas aeruginosa*).

In some embodiments, at least one *Chlamydia* antigenic polypeptide comprises an amino acid sequence identified by any one of SEQ ID NO: 65-72 or 73-183 (Tables 5 or 7). In some embodiments, the amino acid sequence of the *Chlamydia* antigenic polypeptide is, or is a fragment of, or is a homolog or variant having at least 80% (e.g., 85%, 90%, 95%, 98%, 99%) identity to, the amino acid sequence of SEQ ID NO: 65-72 or 73-183 (Tables 5 or 7).

In some embodiments, at least one *Chlamydia* antigenic polypeptide is encoded by a nucleic acid sequence identified by any one of SEQ ID NO: 62-64 or 184-294 (Tables 4 or 8).

In some embodiments, at least one *Chlamydia* RNA (e.g., mRNA) polynucleotide comprises a nucleic acid sequence, or a fragment of a nucleotide sequence, identified by any one of SEQ ID NO: 317-319 or 320-430 (Tables 4 or 8).

HSV

In some embodiments, a RNA (e.g., mRNA) vaccine comprises at least one RNA (e.g., mRNA) polynucleotide having an open reading frame encoding at least one herpes simplex virus (HSV) antigenic polypeptide or an immunogenic fragment thereof (e.g., an immunogenic fragment capable of inducing an immune response to HSV).

In some embodiments, at least one antigenic polypeptide is HSV (HSV-1 or HSV-2) glycoprotein B, HSV (HSV-1 or HSV-2) glycoprotein C, HSV (HSV-1 or HSV-2) glycoprotein D, HSV (HSV-1 or HSV-2) glycoprotein E, HSV (HSV-1 or HSV-2) glycoprotein I. In some embodiments, at least one antigenic polypeptide has at least 95%, at least 96%, at least 97%, at least 98% or at least 99% to HSV (HSV-1 or HSV-2) glycoprotein B, HSV (HSV-1 or HSV-2) glycoprotein C. HSV (HSV-1 or HSV-2) glycoprotein D, HSV (HSV-1 or HSV-2) glycoprotein E, HSV (HSV-1 or HSV-2) glycoprotein I or HSV (HSV-1 or HSV-2) ICP4 protein.

In some embodiments, at least one antigen polypeptide is a non-glycogenic polypeptide, for example, not limited to, HSV (HSV-1 or HSV-2) ICP4 protein. HSV (HSV-1 or HSV-2) ICP0 protein, or an immunogenic fragment thereof.

In some embodiments, at least one antigenic polypeptide has at least 959%, at least 96%, at least 97%, at least 98% or at least 99% to HSV (HSV-1 or HSV-2) glycoprotein B, HSV (HSV-1 or HSV-2) glycoprotein C. HSV (HSV-1 or HSV-2) glycoprotein D, HSV (HSV-1 or HSV-2) glycoprotein E, HSV (HSV-1 or HSV-2) glycoprotein I or HSV (HSV-1 or HSV-2) ICP4 protein.

In some embodiments, at least one antigenic polypeptide is HSV (HSV-1 or HSV-2) glycoprotein C, HSV (HSV-1 or HSV-2) glycoprotein D, a combination of HSV (HSV-1 or HSV-2) glycoprotein C and HSV (HSV-1 or HSV-2) glycoprotein D, or an immunogenic fragment thereof.

In some embodiments, a HSV vaccine includes at least one RNA polynucleotide having an open reading frame encoding HSV (HSV-1 or HSV-2) glycoprotein D. In some embodiments, the HSV vaccine is formulated for intramuscular injection.

In some embodiments, an open reading frame of a RNA (e.g., mRNA) vaccine is codon-optimized. In some embodiments, at least one RNA polynucleotide encodes at least one antigenic polypeptide comprising an amino acid sequence identified by any one of SEQ ID NO: 31-59, 65-72, or 73-183 (Tables 2, 5 or 7, see also amino acid sequences of Tables 3 and 6) and is codon optimized mRNA.

In some embodiments, a RNA (e.g., mRNA) vaccine further comprising an adjuvant.

Tables 3 and 6 provide National Center for Biotechnology Information (NCBI) accession numbers of interest. It should be understood that the phrase "an amino acid sequence of Tables 3 and 6" refers to an amino acid sequence identified by one or more NCBI accession numbers listed in Tables 3 and 6. Each of the amino acid sequences, and variants having greater than 95% identity or greater than 98% identity to each of the amino acid sequences encompassed by the accession numbers of Tables 3 and 6 are included within the constructs (polynucleotides/polypeptides) of the present disclosure.

In some embodiments, at least one mRNA polynucleotide is encoded by a nucleic acid comprising a sequence identified by any one of SEQ ID NO: 1-28, 62-64 or 184-294 (Tables 1, 4 and 8) and having less than 80% identity to wild-type mRNA sequence. In some embodiments, at least one mRNA polynucleotide is encoded by a nucleic acid comprising a sequence identified by any one of SEQ ID NO: 1-28, 62-64 or 184-294 (Tables 1, 4 and 8) and having less than 75%, 85% or 95% identity to a wild-type mRNA sequence. In some embodiments, at least one mRNA polynucleotide is encoded by nucleic acid comprising a sequence identified by any one of SEQ ID NO: 1-28, 62-64 or 184-294 (Tables 1, 4 and 8) and having less than 50-80%, 60-80%, 40-80%, 30-80%, 70-80%, 75-80% or 78-80% identity to wild-type mRNA sequence. In some embodiments, at least one mRNA polynucleotide is encoded by a nucleic acid comprising a sequence identified by any one of SEQ ID NO: 1-28, 62-64 or 184-294 (Tables 1, 4 and 8) and having less than 40-85%, 50-85%, 60-85%, 30-85%, 70-85%, 75-85% or 80-85% identity to wild-type mRNA sequence. In some embodiments, at least one mRNA polynucleotide is encoded by a nucleic acid comprising a sequence identified by any one of SEQ ID NO: 1-28, 62-64 or 184-294 (Tables 1, 4 and 8) and having less than 40-90%, 50-90%, 60-90%, 30-90%, 70-90%, 75-90%, 80-90%, or 85-90% identity to wild-type mRNA sequence.

In some embodiments, at least one RNA polynucleotide encodes at least one antigenic polypeptide comprising an amino acid sequence identified by any one of SEQ ID NO: 31-59, 65-72, or 73-183 (Tables 2, 5 or 7; see also amino acid sequences of Tables 3 and 6) and having at least 80% (e.g., 85%, 90%, 95%, 98%, 99%) identity to wild-type mRNA sequence, but does not include wild-type mRNA sequence.

In some embodiments, at least one RNA polynucleotide encodes at least one antigenic polypeptide comprising an amino acid sequence identified by any one of SEQ ID NO: 31-59, 65-72, or 73-183 (Tables 2, 5 or 7; see also amino acid sequences of Tables 3 and 6) and has less than 95%, 90%, 85%, 80% or 75% identity to wild-type mRNA sequence. In some embodiments, at least one RNA polynucleotide encodes at least one antigenic polypeptide comprising an amino acid sequence identified by any one of SEQ ID NO: 31-59, 65-72, or 73-183 (Tables 2, 5 or 7; see also amino acid sequences of Tables 3 and 6) and has 30-80%, 40-80%, 50-80%, 60-80%, 70-80%, 75-80% or 78-80%, 30-85%, 40-85%, 50-805%, 60-85%, 70-85%, 75-85% or 78-85%, 30-90%, 40-90%, 50-90%, 60-90%, 70-9096, 75-90%, 80-90% or 85-90% identity to wild-type mRNA sequence.

In some embodiments, at least one RNA polynucleotide encodes at least one antigenic polypeptide having at least 90%, at least 95%, at least 96%, at least 97%, at least 98%, or at least 99% identity to an amino acid sequence identified by any one of SEQ ID NO: 31-59, 65-72, or 73-183 (Tables 2, 5 or 7; see also amino acid sequences of Tables 3 and 6). In some embodiments, at least one RNA polynucleotide encodes at least one antigenic polypeptide having 95%-99% identity to an amino acid sequence identified by any one of SEQ ID NO: 31-59, 65-72, or 73-183 (Tables 2, 5 or 7; see also amino acid sequences of Tables 3 and 6).

In some embodiments, at least one RNA polynucleotide encodes at least one antigenic polypeptide having at least 90%, at least 95%, at least 96%, at least 97%, at least 98%, or at least 99% identity to amino acid sequence identified by any one of SEQ ID NO: 31-59, 65-72, or 73-183 (Tables 2, 5 or 7; see also amino acid sequences of Tables 3 and 6) and having membrane fusion activity. In some embodiments, at least one RNA polynucleotide encodes at least one antigenic polypeptide having 95%-99% identity to amino acid sequence identified by any one of SEQ ID NO: 31-59, 65-72, or 73-183 (Tables 2, 5 or 7; see also amino acid sequences of Tables 3 and 6) and having membrane fusion activity.

In some embodiments, at least one RNA polynucleotide encodes at least one antigenic polypeptide (e.g., at least one HPV antigenic polypeptide, at least one HSV antigenic polypeptide and/or at least one (*Chlamydia* (e.g., *C. trachomatis*) antigenic polypeptide) that attaches to cell receptors.

In some embodiments, at least one RNA polynucleotide encodes at least one antigenic polypeptide (e.g., at least one HPV antigenic polypeptide, at least one HSV antigenic polypeptide and/or at least one *Chlamydia* (e.g., *C. trachomatis*) antigenic polypeptide) that causes fusion of viral and cellular membranes.

In some embodiments, at least one RNA polynucleotide encodes at least one antigenic polypeptide (e.g., at least one HPV antigenic polypeptide, at least one HSV antigenic polypeptide and/or at least one *Chlamydia* (e.g., *C. trachomatis*) antigenic polypeptide) that is responsible for binding of the virus to a cell being infected.

Some embodiments of the present disclosure provide a vaccine that includes at least one ribonucleic acid (RNA) (e.g., mRNA) polynucleotide having an open reading frame encoding at least one antigenic polypeptide (e.g., at least one HPV antigenic polypeptide, at least one HSV antigenic polypeptide and/or at least one *Chlamydia* (e.g., *C. trachomatis*) antigenic polypeptide), at least one 5' terminal cap and at least one chemical modification, formulated within a lipid nanoparticle.

In some embodiments, a 5' terminal cap is 7mG(5')ppp(5')NlmpNp.

In some embodiments, at least one chemical modification is selected from pseudouridine, N1-methylpseudouridine, N1-ethylpseudouridine, 2-thiouridine, 4'-thiouridine, 5-methylcytosine, 5-methyluridine, 2-thio-1-methyl-1-deaza-pseudouridine, 2-thio-1-methyl-pseudouridine, 2-thio-5-aza-uridine, 2-thio-dihydropseudouridine, 2-thio-dihydrouridine, 2-thio-pseudouridine, 4-methoxy-2-thio-pseudouridine, 4-methoxy-pseudouridine, 4-thio-1-methyl-pseudouridine, 4-thio-pseudouridine, 5-aza-uridine, dihydropseudouridine, 5-methoxyuridine and 2'-O-methyl uridine. In some embodiments, the chemical modification is in the 5-position of the uracil. In some embodiments, the chemical modification is a N1-methylpseudouridine. In some embodiments, the chemical modification is a N1-ethylpseudouridine.

In some embodiments, a lipid nanoparticle comprises a cationic lipid, a PEG-modified lipid, a sterol and a non-cationic lipid. In some embodiments, a cationic lipid is an ionizable cationic lipid and the non-cationic lipid is a neutral lipid, and the sterol is a cholesterol. In some embodiments, a cationic lipid is selected from the group consisting of 2,2-dilinoleyl-4-dimethylaminoethyl-[1,3]-dioxolane (DLin-KC2-DMA), dilinoleyl-methyl-4-dimethylaminobutyrate (DLin-MC3-DMA), di((Z)-non-2-en-1-yl) 9-((4-(dimethylamino)butanoyl)oxy)heptadecanedioate (L319), (12Z,15Z)—N,N-dimethyl-2-nonylhenicosa-12,15-dien-1-amine (L608), and N,N-dimethyl-1-[(1S,2R)-2-octylcyclopropyl]heptadecan-8-amine (L530).

In some embodiments, the lipid is

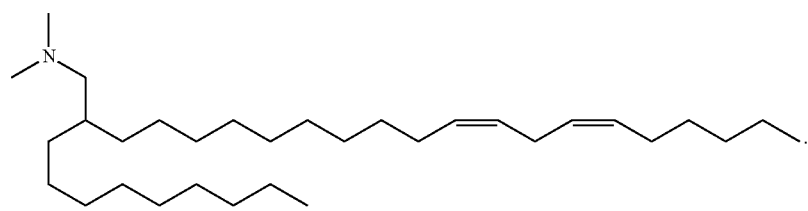

(L608)

In some embodiments, the lipid is

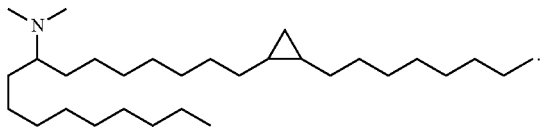

(L530)

In some embodiments, a lipid nanoparticle comprises compounds of Formula (I) and/or Formula (II), discussed below.

In some embodiments, a lipid nanoparticle comprises Compounds 3, 18, 20, 25, 26, 29, 30, 60, 108-112, or 122, as discussed below Some embodiments of the present disclosure provide a vaccine that includes at least one RNA (e.g., mRNA) polynucleotide having an open reading frame encoding at least one antigenic polypeptide (e.g., at least one HPV antigenic polypeptide, at least one HSV antigenic polypeptide and/or at least one *Chlamydia* (e.g., *C. trachomatis*) antigenic polypeptide), wherein at least 80% (e.g., 85%, 90%, 95%, 98%, 99%) of the uracil in the open reading frame have a chemical modification, optionally wherein the vaccine is formulated in a lipid nanoparticle (e.g., a lipid nanoparticle comprises a cationic lipid, a PEG-modified lipid, a sterol and a non-cationic lipid).

In some embodiments, 100% of the uracil in the open reading frame have a chemical modification. In some embodiments, a chemical modification is in the 5-position of the uracil. In some embodiments, a chemical modification is a N1-methyl pseudouridine. In some embodiments, 100% of the uracil in the open reading frame have a N1-methyl pseudouridine in the 5-position of the uracil.

In some embodiments, an open reading frame of a RNA (e.g., mRNA) polynucleotide encodes at least two antigenic polypeptides (e.g., at least one HPV antigenic polypeptide, at least one HSV antigenic polypeptide and/or at least one *Chlamydia* (e.g., *C. trachomatis*) antigenic polypeptide). In some embodiments, the open reading frame encodes at least five or at least ten antigenic polypeptides. In some embodiments, the open reading frame encodes at least 100 antigenic polypeptides. In some embodiments, the open reading frame encodes 2-100 antigenic polypeptides.

In some embodiments, a vaccine comprises at least two RNA (e.g., mRNA) polynucleotides, each having an open reading frame encoding at least one antigenic polypeptide (e.g., at least one HPV antigenic polypeptide, at least one HSV antigenic polypeptide and/or at least one *Chlamydia* (e.g. *C. trachomatis*) antigenic polypeptide). In some embodiments, the vaccine comprises at least five or at least ten RNA (e.g., mRNA) polynucleotides, each having an open reading frame encoding at least one antigenic polypeptide or an immunogenic fragment thereof. In some embodiments, the vaccine comprises at least 100 RNA (e.g., mRNA) polynucleotides, each having an open reading frame encoding at least one antigenic polypeptide. In some embodiments, the vaccine comprises 2-100 RNA (e.g., mRNA) polynucleotides, each having an open reading frame encoding at least one antigenic polypeptide.

In some embodiments, at least one antigenic polypeptide (e.g., at least one HPV antigenic polypeptide, at least one HSV antigenic polypeptide and/or at least one *Chlamydia* (e.g., *C. trachomatis*) antigenic polypeptide) is fused to a signal peptide. In some embodiments, the signal peptide is selected from: a HuIgGk signal peptide (METPAQLL-FLLLLWLPDTITG; SEQ ID NO: 304); IgE heavy chain epsilon-1 signal peptide (MDWTWILFLVAAATRVHS; SEQ ID NO: 305); Japanese encephalitis PRM signal sequence (MLGSNSGQRVVFTILLLLVAPAYS; SEQ ID NO: 306). VSVg protein signal sequence (MKCLLYLAFL-FIGVNCA; SEQ ID NO: 307) and Japanese encephalitis JEV signal sequence (MWLVSLAIVTACAGA; SEQ ID NO: 308).

In some embodiments, the signal peptide is fused to the N-terminus of at least one antigenic polypeptide. In some embodiments, a signal peptide is fused to the C-terminus of at least one antigenic polypeptide.

In some embodiments, at least one antigenic polypeptide (e.g., at least one HPV antigenic polypeptide, at least one HSV antigenic polypeptide and/or at least one *Chlamydia* (e.g., *C. trachomatis*) antigenic polypeptide) comprises a mutated N-linked glycosylation site.

Also provided herein is a RNA (e.g., mRNA) vaccine of any one of the foregoing paragraphs (e.g., at least one HPV antigenic polypeptide, at least one HSV antigenic polypeptide and/or at least one *Chlamydia* (e.g., *C. trachomatis*) antigenic polypeptide), formulated in a nanoparticle (e.g., a lipid nanoparticle).

In some embodiments, the nanoparticle has a mean diameter of 50-200 nm. In some embodiments, the nanoparticle is a lipid nanoparticle. In some embodiments, the lipid nanoparticle comprises a cationic lipid, a PEG-modified lipid, a sterol and a non-cationic lipid. In some embodiments, the lipid nanoparticle comprises a molar ratio of about 20-60% cationic lipid, 0.5-15% PEG-modified lipid, 25-55% sterol, and 25% non-cationic lipid. In some embodiments, the cationic lipid is an ionizable cationic lipid and the non-cationic lipid is a neutral lipid, and the sterol is a cholesterol. In some embodiments, the cationic lipid is selected from 2,2-dilinoleyl-4-dimethylaminoethyl-[1,3]-dioxolane (DLin-KC2-DMA), dilinoleyl-methyl-4-dimethyl-aminobutyrate (DLin-MC3-DMA), and di((Z)-non-2-en-1-yl) 9-((4-(dimethylamino)butanoyl)oxy)heptadecanedioate (L319).

In some embodiments, a lipid nanoparticle comprises compounds of Formula (I) and/or Formula (II), discussed below.

In some embodiments, a STD RNA (e.g., mRNA) vaccine is formulated in a lipid nanoparticle that comprises a compound selected from Compounds 3, 18, 20, 25, 26, 29, 30, 60, 108-112 and 122, described below.

In some embodiments, the nanoparticle has a polydispersity value of less than 0.4 (e.g., less than 0.3, 0.2 or 0.1).

In some embodiments, the nanoparticle has a net neutral charge at a neutral pH value.

In some embodiments, the RNA (e.g., mRNA) vaccine is multivalent.

Some embodiments of the present disclosure provide methods of inducing an antigen specific immune response in a subject, comprising administering to the subject any of the RNA (e.g., mRNA) vaccine as provided herein in an amount effective to produce an antigen-specific immune response. In some embodiments, the RNA (e.g., mRNA) vaccine is a HPV vaccine, a HSV vaccine or a *Chlamydia* (e.g., *C. trachomatis*) vaccine. In some embodiments, the RNA (e.g., mRNA) vaccine is a combination vaccine comprising a combination of HPV vaccine, a HSV vaccine and *Chlamydia* (e.g., *C. trachomatis*) vaccine.

In some embodiments, an antigen-specific immune response comprises a T cell response or a B cell response.

In some embodiments, a method of producing an antigen-specific immune response comprises administering to a subject a single dose (no booster dose) of a RNA (e.g., mRNA) vaccine of the present disclosure. In some embodiments, the RNA (e.g., mRNA) vaccine is a HPV vaccine, a HSV vaccine and/or *Chlamydia* (e.g., *C. trachomatis*) vaccine. In some embodiments, the RNA (e.g., mRNA) vaccine is a combination vaccine comprising a combination of any two or more of the foregoing vaccines.

In some embodiments, a method further comprises administering to the subject a second (booster) dose of a RNA (e.g., mRNA) vaccine. Additional doses of a RNA (e.g., mRNA) vaccine may be administered.

In some embodiments, the subjects exhibit a seroconversion rate of at least 80% (e.g., at least 85%, at least 90%, or at least 95%) following the first dose or the second (booster) dose of the vaccine. Seroconversion is the time period during which a specific antibody develops and becomes detectable in the blood. After seroconversion has occurred, a virus can be detected in blood tests for the antibody. During an infection or immunization, antigens enter the blood, and the immune system begins to produce antibodies in response. Before seroconversion, the antigen itself may or may not be detectable, but antibodies are considered absent. During seroconversion, antibodies are present but not yet detectable. Any time after seroconversion, the antibodies can be detected in the blood, indicating a prior or current infection.

In some embodiments, a RNA (e.g., mRNA) vaccine is administered to a subject by intradermal, intramuscular injection, or by intranasal administration.

Some embodiments, of the present disclosure provide methods of inducing an antigen specific immune response in a subject, including administering to a subject a RNA (e.g., mRNA) vaccine in an effective amount to produce an antigen specific immune response in a subject. Antigen-specific immune responses in a subject may be determined, in some embodiments, by assaying for antibody titer (for titer of an antibody that binds to a HPV antigenic polypeptide, a HSV antigenic polypeptide and/or a *Chlamydia* (e.g. *C. trachomatis*) antigenic polypeptide) following administration to the subject of any of the RNA (e.g., mRNA) vaccines of the present disclosure. In some embodiments, the anti-antigenic polypeptide antibody titer produced in the subject is increased by at least 1 log relative to a control. In some embodiments, the anti-antigenic polypeptide antibody titer produced in the subject is increased by 1-3 log relative to a control.

In some embodiments, the anti-antigenic polypeptide antibody titer produced in a subject is increased at least 2 times relative to a control. In some embodiments, the anti-antigenic polypeptide antibody titer produced in the subject is increased at least 5 times relative to a control. In some embodiments, the anti-antigenic polypeptide antibody titer produced in the subject is increased at least 10 times relative to a control. In some embodiments, the anti-antigenic polypeptide antibody titer produced in the subject is increased 2-10 times relative to a control.

In some embodiments, the control is an anti-antigenic polypeptide antibody titer produced in a subject who has not been administered a RNA (e.g., mRNA) vaccine of the present disclosure. In some embodiments, the control is an anti-antigenic polypeptide antibody titer produced in a subject who has been administered a live attenuated or inactivated HPV, HSV and/or *Chlamydia* vaccine (see, e.g., Ren J. et al. *J of Gen. Virol.* 2015; 96: 1515-1520), or wherein the control is an anti-antigenic polypeptide antibody titer produced in a subject who has been administered a recombinant or purified HPV, HSV and/or *Chlamydia* protein vaccine. In some embodiments, the control is an anti-antigenic polypeptide antibody titer produced in a subject who has been administered a HPV, HSV and/or *Chlamydia* virus-like particle (VLP) vaccine (see, e.g., Cox R G et al., *J Virol.* 2014 June; 88(11): 6368-6379).

A RNA (e.g., mRNA) vaccine of the present disclosure is administered to a subject in an effective amount (an amount effective to induce an immune response). In some embodiments, the effective amount is a dose equivalent to an at least 2-fold, at least 4-fold, at least 10-fold, at least 100-fold, at least 1000-fold reduction in the standard of care dose of a recombinant HPV, HSV and/or *Chlamydia* protein vaccine, wherein the anti-antigenic polypeptide antibody titer produced in the subject is equivalent to an anti-antigenic polypeptide antibody titer produced in a control subject administered the standard of care dose of a recombinant HPV, HSV and/or *Chlamydia* protein vaccine, a purified HPV, HSV and/or *Chlamydia* protein vaccine, a live attenuated HPV, HSV and/or *Chlamydia* vaccine, an inactivated HPV, HSV and/or *Chlamydia* vaccine, or a HPV, HSV and/or *Chlamydia* VLP vaccine. In some embodiments, the effective amount is a dose equivalent to 2-1000-fold reduction in the standard of care dose of a recombinant HPV, HSV and/or *Chlamydia* protein vaccine, wherein the anti-antigenic polypeptide antibody titer produced in the subject is equivalent to an anti-antigenic polypeptide antibody titer produced in a control subject administered the standard of care dose of a recombinant HPV, HSV and/or *Chlamydia* protein vaccine, a purified HPV, HSV and/or *Chlamydia* protein vaccine, a live attenuated HPV, HSV and/or *Chlamydia* vaccine, an inactivated HPV, HSV and/or *Chlamydia* vaccine, or a HPV, HSV and/or *Chlamydia* VLP vaccine.

In some embodiments, the control is an anti-antigenic polypeptide antibody titer produced in a subject who has been administered a virus-like particle (VLP) vaccine comprising structural proteins of HPV, HSV and/or *Chlamydia*.

In some embodiments, the RNA (e.g., mRNA) vaccine is formulated in an effective amount to produce an antigen specific immune response in a subject.

In some embodiments, the effective amount is a total dose of 25 µg to 1000 µg, or 50 µg to 1000 µg. In some embodiments, the effective amount is a total dose of 100 µg. In some embodiments, the effective amount is a dose of 25 µg administered to the subject a total of two times. In some embodiments, the effective amount is a dose of 100 µg administered to the subject a total of two times. In some embodiments, the effective amount is a dose of 400 µg administered to the subject a total of two times. In some embodiments, the effective amount is a dose of 500 µg administered to the subject a total of two times.

In some embodiments, the efficacy (or effectiveness) of a RNA (e.g., mRNA) vaccine is greater than 60%. In some embodiments, the RNA (e.g., mRNA) polynucleotide of the vaccine at least one HPV antigenic polypeptide, at least one HSV antigenic polypeptide and/or at least one *Chlamydia* (e.g., *C. trachomatis*) antigenic polypeptide.

Vaccine efficacy may be assessed using standard analyses (see, e.g., Weinberg et al., *J Infect Dis.* 2010 Jun. 1:201(11): 1607-10). For example, vaccine efficacy may be measured by double-blind, randomized, clinical controlled trials. Vaccine efficacy may be expressed as a proportionate reduction in disease attack rate (AR) between the unvaccinated (ARU) and vaccinated (ARV) study cohorts and can be calculated from the relative risk (RR) of disease among the vaccinated group with use of the following formulas:

Efficacy=(ARU−ARV)/ARU×100; and

Efficacy=(1−RR)×100.

Likewise, vaccine effectiveness may be assessed using standard analyses (see. e.g., Weinberg et al., *J Infect Dis.* 2010 Jun. 1; 201(11):1607-10). Vaccine effectiveness is an assessment of how a vaccine (which may have already proven to have high vaccine efficacy) reduces disease in a population. This measure can assess the net balance of benefits and adverse effects of a vaccination program, not just the vaccine itself, under natural field conditions rather than in a controlled clinical trial. Vaccine effectiveness is proportional to vaccine efficacy (potency) but is also affected by how well target groups in the population are immunized, as well as by other non-vaccine-related factors that influence the 'real-world' outcomes of hospitalizations, ambulatory visits, or costs. For example, a retrospective case control analysis may be used, in which the rates of vaccination among a set of infected cases and appropriate controls are compared. Vaccine effectiveness may be expressed as a rate difference, with use of the odds ratio (OR) for developing infection despite vaccination:

Effectiveness=(1−OR)×100.

In some embodiments, the efficacy (or effectiveness) of a RNA (e.g., mRNA) vaccine is at least 65%, at least 70%, at least 75%, at least 80%, at least 85%, or at least 90%.

In some embodiments, the vaccine immunizes the subject against HPV, a HSV antigenic polypeptide and/or *Chlamydia* (e.g., *C. trachomatis*) for up to 2 years. In some embodiments, the vaccine immunizes the subject against HPV, HSV and/or *Chlamydia* (e.g., *C. trachomatis*) for more than 2 years, more than 3 years, more than 4 years, or for 5-10 years.

In some embodiments, the subject is about 5 years old or younger. For example, the subject may be between the ages of about 1 year and about 5 years (e.g., about 1, 2, 3, 5 or 5 years), or between the ages of about 6 months and about 1 year (e.g., about 6, 7, 8, 9, 10, 11 or 12 months). In some embodiments, the subject is about 12 months or younger (e.g., 12, 11, 10, 9, 8, 7, 6, 5, 4, 3, 2 months or 1 month). In some embodiments, the subject is about 6 months or younger.

In some embodiments, the subject was born full term (e.g., about 37-42 weeks). In some embodiments, the subject was born prematurely, for example, at about 36 weeks of gestation or earlier (e.g., about 36, 35, 34, 33, 32, 31, 30, 29, 28, 27, 26 or 25 weeks). For example, the subject may have been born at about 32 weeks of gestation or earlier. In some embodiments, the subject was born prematurely between about 32 weeks and about 36 weeks of gestation. In such subjects, a RNA (e.g., mRNA) vaccine may be administered later in life, for example, at the age of about 6 months to about 5 years, or older.

In some embodiments, the subject is a young adult between the ages of about 20 years and about 50 years (e.g., about 20, 25, 30, 35, 40, 45 or 50 years old).

In some embodiments, the subject is an elderly subject about 60 years old, about 70 years old, or older (e.g., about 60, 65, 70, 75, 80, 85 or 90 years old).

In some embodiments, the subject has been exposed to HPV, HSV and/or *Chlamydia* (e.g., *C. trachomatis*); the subject is infected with HPV, HSV and/or *Chlamydia* (e.g., *C. trachomatis*); or subject is at risk of infection by HPV, HSV and/or *Chlamydia* (e.g., *C. trachomatis*).

In some embodiments, the subject is immunocompromised (has an impaired immune system, e.g., has an immune disorder or autoimmune disorder).

In some embodiments the nucleic acid vaccines described herein are chemically modified. In other embodiments the nucleic acid vaccines are unmodified.

Yet other aspects provide compositions for and methods of vaccinating a subject comprising administering to the subject a nucleic acid vaccine comprising one or more RNA polynucleotides having an open reading frame encoding a first respiratory virus antigenic polypeptide, wherein the RNA polynucleotide does not include a stabilization element, and wherein an adjuvant is not coformulated or co-administered with the vaccine.

In other aspects the invention is a composition for or method of vaccinating a subject comprising administering to the subject a nucleic acid vaccine comprising one or more RNA polynucleotides having an open reading frame encoding a first antigenic polypeptide wherein a dosage of between 10 µg/kg and 400 µg/kg of the nucleic acid vaccine is administered to the subject. In some embodiments the dosage of the RNA polynucleotide is 1-5 µg, 5-10 µg, 10-15 µg, 15-20 µg, 10-25 µg, 20-25 µg, 20-50 µg, 30-50 µg, 40-50 µg, 40-60 µg, 60-80 µg, 60-100 µg, 50-100 µg, 80-120 µg, 40-120 µg, 40-150 µg, 50-150 µg, 50-200 µg, 80-200 µg, 100-200 µg, 120-250 µg, 150-250 µg, 180-280 µg, 200-300 µg, 50-300 µg, 80-300 µg, 100-300 µg, 40-300 µg, 50-350 µg, 100-350 µg, 200-350 µg, 300-350 µg, 320-400 µg, 40-380 µg, 40-100 µg, 100-400 µg, 200-400 µg, or 300-400 µg per dose. In some embodiments, the nucleic acid vaccine is administered to the subject by intradermal or intramuscular injection. In some embodiments, the nucleic acid vaccine is administered to the subject on day zero. In some embodiments, a second dose of the nucleic acid vaccine is administered to the subject on day twenty one.

In some embodiments, a dosage of 25 micrograms of the RNA polynucleotide is included in the nucleic acid vaccine administered to the subject. In some embodiments, a dosage of 100 micrograms of the RNA polynucleotide is included in the nucleic acid vaccine administered to the subject. In some embodiments, a dosage of 50 micrograms of the RNA polynucleotide is included in the nucleic acid vaccine administered to the subject. In some embodiments, a dosage of 75 micrograms of the RNA polynucleotide is included in the nucleic acid vaccine administered to the subject. In some embodiments, a dosage of 150 micrograms of the RNA polynucleotide is included in the nucleic acid vaccine administered to the subject. In some embodiments, a dosage of 400 micrograms of the RNA polynucleotide is included in the nucleic acid vaccine administered to the subject. In some embodiments, a dosage of 200 micrograms of the RNA polynucleotide is included in the nucleic acid vaccine administered to the subject. In some embodiments, the RNA polynucleotide accumulates at a 100 fold higher level in the local lymph node in comparison with the distal lymph node. In other embodiments the nucleic acid vaccine is chemically modified and in other embodiments the nucleic acid vaccine is not chemically modified.

Aspects of the invention provide a nucleic acid vaccine comprising one or more RNA polynucleotides having an open reading frame encoding a first antigenic polypeptide, wherein the RNA polynucleotide does not include a stabilization element, and a pharmaceutically acceptable carrier or excipient, wherein an adjuvant is not included in the vaccine. In some embodiments, the stabilization element is a histone stem-loop. In some embodiments, the stabilization element is a nucleic acid sequence having increased GC content relative to wild type sequence.

Aspects of the invention provide nucleic acid vaccines comprising one or more RNA polynucleotides having an open reading frame encoding a first antigenic polypeptide, wherein the RNA polynucleotide is present in the formulation for in vivo administration to a host, which confers an antibody titer superior to the criterion for seroprotection for the first antigen for an acceptable percentage of human subjects. In some embodiments, the antibody titer produced by the mRNA vaccines of the invention is a neutralizing antibody titer. In some embodiments the neutralizing antibody titer is greater than a protein vaccine. In other embodiments the neutralizing antibody titer produced by the mRNA vaccines of the invention is greater than an adjuvanted protein vaccine. In yet other embodiments the neutralizing antibody titer produced by the mRNA vaccines of the invention is 1,000-10,000, 1,200-10,000, 1,400-10,000, 1,500-10,000, 1,000-5,000, 1,000-4,000, 1,800-10,000, 2000-10,000, 2,000-5,000, 2,000-3,000, 2,000-4,000, 3,000-5,000, 3,000-4,000, or 2,000-2,500. A neutralization titer is typically expressed as the highest serum dilution required to achieve a 50% reduction in the number of plaques.

Also provided are nucleic acid vaccines comprising one or more RNA polynucleotides having an open reading frame encoding a first antigenic polypeptide, wherein the RNA polynucleotide is present in a formulation for in vivo administration to a host for eliciting a longer lasting high antibody titer than an antibody titer elicited by an mRNA vaccine having a stabilizing element or formulated with an adjuvant and encoding the first antigenic polypeptide. In some embodiments, the RNA polynucleotide is formulated to produce a neutralizing antibodies within one week of a single administration. In some embodiments, the adjuvant is selected from a cationic peptide and an immunostimulatory nucleic acid. In some embodiments, the cationic peptide is protamine.

Aspects provide nucleic acid vaccines comprising one or more RNA pol nucleotides having an open reading frame comprising at least one chemical modification or optionally no chemical modification, the open reading frame encoding a first antigenic polypeptide, wherein the RNA polynucleotide is present in the formulation for in vivo administration to a host such that the level of antigen expression in the host significantly exceeds a level of antigen expression produced by an mRNA vaccine having a stabilizing element or formulated with an adjuvant and encoding the first antigenic polypeptide.

Other aspects provide nucleic acid vaccines comprising one or more RNA polynucleotides having an open reading frame comprising at least one chemical modification or optionally no chemical modification, the open reading frame encoding a first antigenic polypeptide, wherein the vaccine has at least 10 fold less RNA polynucleotide than is required for an unmodified mRNA vaccine to produce an equivalent antibody titer. In some embodiments, the RNA polynucleotide is present in a dosage of 25-100 micrograms.

Aspects of the invention also provide a unit of use vaccine, comprising between 10 ug and 400 ug of one or more RNA polynucleotides having an open reading frame comprising at least one chemical modification or optionally no chemical modification, the open reading frame encoding a first antigenic polypeptide, and a pharmaceutically acceptable carrier or excipient, formulated for delivery to a human subject. In some embodiments, the vaccine further comprises a cationic lipid nanoparticle.

Aspects of the invention provide methods of creating, maintaining or restoring antigenic memory to a respiratory virus strain in an individual or population of individuals comprising administering to said individual or population an antigenic memory booster nucleic acid vaccine comprising (a) at least one RNA polynucleotide, said polynucleotide comprising at least one chemical modification or optionally no chemical modification and two or more codon-optimized open reading frames, said open reading frames encoding a set of reference antigenic polypeptides, and (b) optionally a pharmaceutically acceptable carrier or excipient. In some embodiments, the vaccine is administered to the individual via a route selected from the group consisting of intramuscular administration, intradermal administration and subcutaneous administration. In some embodiments, the administering step comprises contacting a muscle tissue of the subject with a device suitable for injection of the composition. In some embodiments, the administering step comprises contacting a muscle tissue of the subject with a device suitable for injection of the composition in combination with electroporation.

Aspects of the invention provide methods of vaccinating a subject comprising administering to the subject a single dosage of between 25 ug/kg and 400 ug/kg of a nucleic acid vaccine comprising one or more RNA polynucleotides having an open reading frame encoding a first antigenic polypeptide in an effective amount to vaccinate the subject.

Other aspects provide nucleic acid vaccines comprising one or more RNA polynucleotides having an open reading frame comprising at least one chemical modification, the open reading frame encoding a first antigenic polypeptide, wherein the vaccine has at least 10 fold less RNA polynucleotide than is required for an unmodified mRNA vaccine to produce an equivalent antibody titer. In some embodiments, the RNA polynucleotide is present in a dosage of 25-100 micrograms.

Other aspects provide nucleic acid vaccines comprising an LNP formulated RNA polynucleotide having an open reading frame comprising no modifications (unmodified), the open reading frame encoding a first antigenic polypeptide, wherein the vaccine has at least 10 fold less RNA polynucleotide than is required for an unmodified mRNA vaccine not formulated in a LNP to produce an equivalent antibody titer. In some embodiments, the RNA polynucleotide is present in a dosage of 25-100 micrograms.

The data presented in the Examples demonstrate significant enhanced immune responses using the formulations of the invention. The data demonstrated the effectiveness of both chemically modified and unmodified RNA vaccines of the invention. Surprisingly, in contrast to prior art reports that it was preferable to use chemically unmodified mRNA formulated in a carrier for the production of vaccines, it was discovered herein that chemically modified mRNA-LNP vaccines required a much lower effective mRNA dose than unmodified mRNA. i.e., tenfold less than unmodified mRNA when formulated in carriers other than LNP. Both the chemically modified and unmodified RNA vaccines of the invention produce better immune responses than mRNA vaccines formulated in a different lipid carrier.

In other aspects the invention encompasses a method of treating an elderly subject age 60 years or older comprising administering to the subject a nucleic acid vaccine comprising one or more RNA polynucleotides having an open reading frame encoding a respiratory virus antigenic polypeptide in an effective amount to vaccinate the subject.

In other aspects the invention encompasses a method of treating a young subject age 17 years or younger comprising administering to the subject a nucleic acid vaccine comprising one or more RNA polynucleotides having an open reading frame encoding a respiratory virus antigenic polypeptide in an effective amount to vaccinate the subject.

In other aspects the invention encompasses a method of treating an adult subject comprising administering to the subject a nucleic acid vaccine comprising one or more RNA polynucleotides having an open reading frame encoding a respiratory virus antigenic polypeptide in an effective amount to vaccinate the subject.

In some aspects the invention is a method of vaccinating a subject with a combination vaccine including at least two nucleic acid sequences encoding respiratory antigens wherein the dosage for the vaccine is a combined therapeutic dosage wherein the dosage of each individual nucleic acid encoding an antigen is a sub therapeutic dosage. In some embodiments, the combined dosage is 25 micrograms of the RNA polynucleotide in the nucleic acid vaccine administered to the subject. In some embodiments, the combined dosage is 100 micrograms of the RNA polynucleotide in the nucleic acid vaccine administered to the subject. In some embodiments the combined dosage is 50 micrograms of the RNA polynucleotide in the nucleic acid vaccine administered to the subject. In some embodiments, the combined dosage is 75 micrograms of the RNA polynucleotide in the nucleic acid vaccine administered to the subject. In some embodiments, the combined dosage is 150 micrograms of the RNA polynucleotide in the nucleic acid vaccine administered to the subject. In some embodiments, the combined dosage is 400 micrograms of the RNA polynucleotide in the nucleic acid vaccine administered to the subject. In some embodiments, the sub therapeutic dosage of each individual nucleic acid encoding an antigen is 1, 2, 3, 4, 5, 6, 7, 8, 9, 10, 11, 12, 13, 14, 15, 16, 17, 18, 19, or 20 micrograms. In other embodiments the nucleic acid vaccine is chemically modified and in other embodiments the nucleic acid vaccine is not chemically modified.

The RNA polynucleotide is one of SEQ ID NO: 1-28, 62-64, 184-294 431-461 and includes at least one chemical modification. In other embodiments the RNA polynucleotide is one of SEQ ID NO: 1-28, 62-64, 184-294 431-461 and does not include any nucleotide modifications, or is unmodified. In yet other embodiments the at least one RNA polynucleotide encodes an antigenic protein of any of SEQ ID NO: 31-59, 65-72, or 73-183 and includes at least one chemical modification. In other embodiments the RNA polynucleotide encodes an antigenic protein of any of SEQ ID NO: 31-59, 65-72, or 73-183 and does not include any nucleotide modifications, or is unmodified.

In preferred aspects, vaccines of the invention (e.g., LNP-encapsulated mRNA vaccines) produce prophylactically- and/or therapeutically-efficacious levels, concentrations and/or titers of antigen-specific antibodies in the blood or serum of a vaccinated subject. As defined herein, the term antibody titer refers to the amount of antigen-specific antibody produces in s subject, e.g., a human subject. In exemplary embodiments, antibody titer is expressed as the inverse of the greatest dilution (in a serial dilution) that still gives a positive result. In exemplary embodiments, antibody titer is determined or measured by enzyme-linked immunosorbent assay (ELISA). In exemplary embodiments, antibody titer is determined or measured by neutralization assay, e.g., by microneutralization assay. In certain aspects, antibody titer measurement is expressed as a ratio, such as 1:40, 1:100, etc.

In exemplary embodiments of the invention, an efficacious vaccine produces an antibody titer of greater than 1:40, greater that 1:100, greater than 1:400, greater than 1:1000, greater than 1:2000, greater than 1:3000, greater than 1:4000, greater than 1:500, greater than 1:6000, greater than 1:7500, greater than 1:10000. In exemplary embodiments, the antibody titer is produced or reached by 10 days following vaccination, by 20 days following vaccination, by 30 days following vaccination, by 40 days following vaccination, or by 50 or more days following vaccination. In exemplary embodiments, the titer is produced or reached following a single dose of vaccine administered to the subject. In other embodiments, the titer is produced or reached following multiple doses, e.g., following a first and a second dose (e.g., a booster dose.)

In exemplary aspects of the invention, antigen-specific antibodies are measured in units of µg/ml or are measured in units of IU/L (International Units per liter) or mIU/ml (milli International Units per ml). In exemplary embodiments of the invention, an efficacious vaccine produces >0.5 µg/ml, >0.1 µg/ml, >0.2 µg/ml, >0.35 µg/ml, >0.5 µg/ml, >1 µg/ml, >2 µg/ml, >5 µg/ml or >10 µg/ml. In exemplary embodiments of the invention, an efficacious vaccine produces >10 mIU/ml, >20 mIU/ml, >50 mIU/ml, >100 mIU/ml, >200 mIU/ml, >500) mIU/ml or >1000 mIU/ml. In exemplary embodiments, the antibody level or concentration is produced or reached by 10 days following vaccination, by 20 days following vaccination, by 30 days following vaccination, by 40 days following vaccination, or by 50 or more days following vaccination. In exemplary embodiments, the level or concentration is produced or reached following a single dose of vaccine administered to the subject. In other embodiments, the level or concentration is produced or reached following multiple doses, e.g., following a first and a second dose (e.g., a booster dose.) In exemplary embodiments, antibody level or concentration is determined or measured by enzyme-linked immunosorbent assay (ELISA). In exemplary embodiments, antibody level or concentration is determined or measured by neutralization assay, e.g., by microneutralization assay.

The details of various embodiments of the disclosure are set forth in the description below. Other features, objects, and advantages of the disclosure will be apparent from the description and from the claims.

BRIEF DESCRIPTION OF THE DRAWINGS

FIGS. 2A-2B are western blot graphs showing the in vitro expression of *Chlamydia trachomatis* antigens encoded by candidate mRNA vaccines. All antigens tested expressed in HEK293F cells. FIG. 2A shows the expression of PmPG_pd, Ct460, and Ct622 in concentrated supernatant of HEK293K cells. FIG. 2B shows the expression of Cta1 in HEK293F cell lysates.

DETAILED DESCRIPTION

Figure 1A:
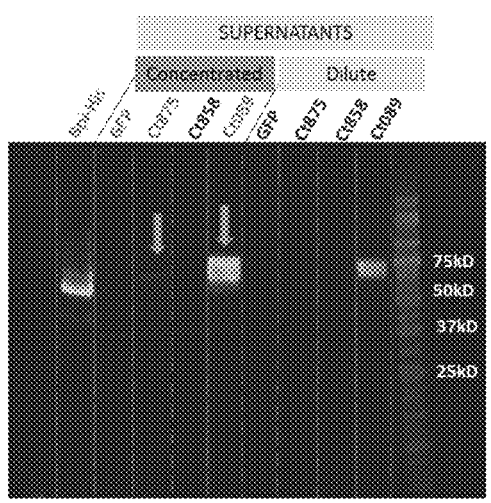
FIGS. 1A-1B are western blot graphs showing the in vitro expression of *Chlamydia trachomatis* antigens (Ct089, Ct858, and Ct875) encoded by candidate mRNA vaccines.
Figure 1B:
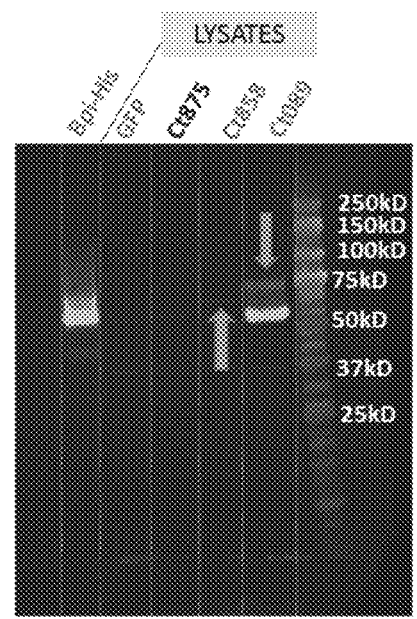
Figure 2A:
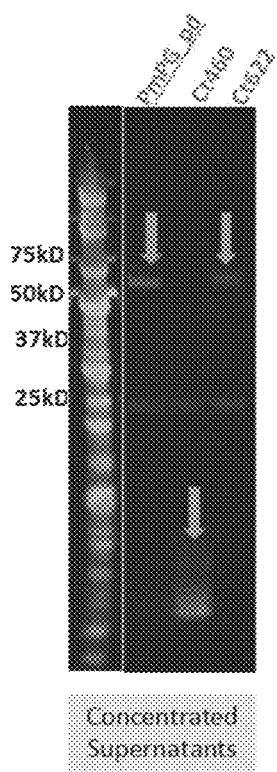
FIG. 2A shows the expression of these antigens in concentrated or dilute supernatant of HEK293K cells. Expression of Ct875 and Ct089 was detected in the supernatants.
Figure 2B:
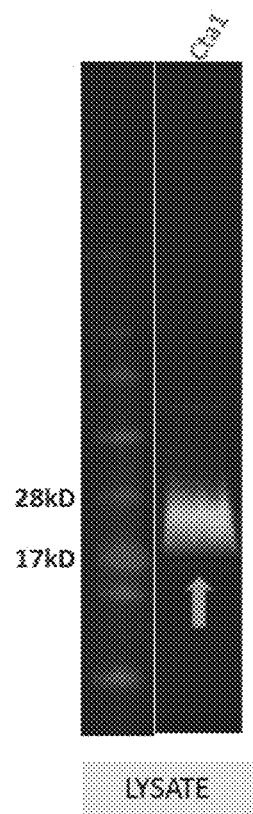
FIG. 2B shows the expression of these antigens in HEK293F cell lysates. Expression of Ct858 and Ct089 was detected in the cell lysates.
Figure 3:
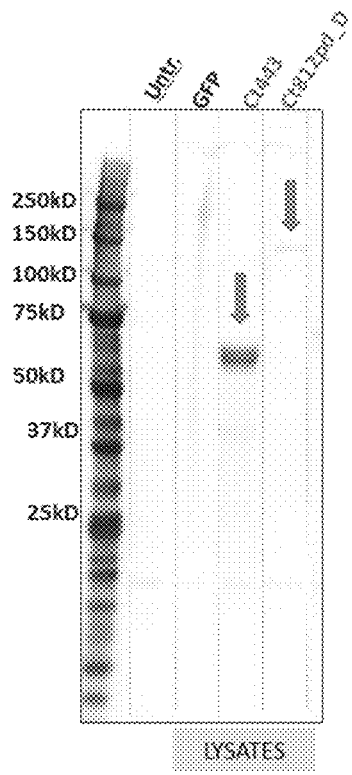
FIG. 3 is a western blot graph showing the in vitro expression of *Chlamydia trachomatis* antigens (Ct 443 and Ct812pd_D) encoded by candidate mRNA vaccines. The expression of Ct443 and Ct812pd_D were detected in the cell lysates.

The present disclosure provides, in some embodiments, vaccines that comprise RNA (e.g., mRNA) polynucleotides encoding a human papillomavirus (HPV) antigenic polypeptide, a herpes simplex virus (HSV) antigenic polypeptide, and/or a *Chlamydia* (e.g. *C. trachomatis*) antigenic polypeptide. The present disclosure also provides, in some embodiments, combination vaccines that comprise at least one RNA (e.g., mRNA) polynucleotide encoding at least two antigenic polypeptides selected from HPV antigenic polypeptides, HSV antigenic polypeptides, and *Chlamydia* (e.g., *C. trachomatis*) antigenic polypeptides. Also provided herein are methods of administering the RNA (e.g., mRNA) vaccines, methods of producing the RNA (e.g., mRNA) vaccines, compositions (e.g., pharmaceutical compositions) comprising the RNA (e.g., mRNA) vaccines, and nucleic acids (e.g., DNA) encoding the RNA (e.g., mRNA) vaccines. In some embodiments, a RNA (e.g., mRNA) vaccine comprises an adjuvant, such as a flagellin adjuvant, as provided herein.

The RNA (e.g., mRNA) vaccines (e.g., HPV, HSV and/or *Chlamydia* RNA vaccines), in some embodiments, may be used to induce a balanced immune response, comprising both cellular and humoral immunity, without many of the risks associated with DNA vaccination.

The entire contents of International Application No. PCT/US2015/02740 is incorporated herein by reference.

Human Papillomavirus (HPV)

Major capsid protein L1 forms an icoshedral capsid with a T=7 symmetry and a 50 nm diameter. The capsid is composed of 72 pentamers linked to each other by disulfide bonds and associated with L2 proteins. HPV capsid proteins bind to heparan sulfate proteoglycans on the basement membrane of target cells to provide initial virion attachment to the target cells. The basement membrane is exposed only after epithelium trauma. Additionally, the alpha6 integrin complexed with either beta1 or beta4 integrin acts as a coreceptor recognized by L1. Once attached, the virion enters the host cell via clathrin-mediated endocytosis, and the genomic DNA is released to the host nucleus. The virion assembly takes place within the cell nucleus. L1 protein encapsulates the genomic DNA together with L2 protein.

A HPV vaccine may comprise, for example, at least one RNA (e.g., mRNA) polynucleotide having an open reading frame encoding at least one HPV antigenic polypeptide identified by SEQ ID NO: 35-59 (Table 2).

A HPV vaccine may comprise, for example, at least one RNA (e.g., mRNA) polynucleotide encoded by a nucleic acid (e.g., DNA) identified by SEQ ID NO: 1-28 (Table 1).

The present disclosure is not limited by a particular strain of HPV. The strain of HPV used in a vaccine may be any strain of HPV. Non-limiting examples of strains of HPV are provided elsewhere herein.

In some embodiments, HPV vaccines comprise RNA (e.g., mRNA) encoding a HPV antigenic polypeptide having at least 95%, at least 96%, at least 97%, at least 98% or at least 99% identity with HPV L1 or HPV L2 activity and having HPV L1 or HPV L2 activity, respectively.

A protein is considered to have HPV L1 protein activity if, for example, it binds to heparan sulfate proteoglycans on the basement membrane to provide initial virion attachment to target cells.

*Chlamydia*

Embodiments of the present disclosure provide RNA (e.g., mRNA) vaccines that include at least one polynucleotide encoding at least one *Chlamydia* (e.g., *C. trachomatis*) antigen. *Chlamydia trachomatis*, an obligate intracellular human pathogen, is one of four bacterial species in the genus *Chlamydia*. *Chlamydia trachomatis* is a Gram-negative bacterium, ovoid in shape. *Chlamydia trachomatis* includes three human biovars (variant prokaryotic strains): (1) serovars (or serotypes) Ab, B, Ba and C, which cause trachoma infection of the eyes, which can lead to blindness, (2) serovars D-K, which cause urethritis, pelvic inflammatory disease, ectopic pregnancy, neonatal pneumonia and neonatal conjunctivitis; and (3) serovars L1, L2 and L3, which cause lymphogranuloma venereum.

Major outer membrane protein (MOMP) is the dominant surface protein of the bacteria (contributing to 60% of the total protein mass in the outer membrane) and consists of four variable domains interspersed among five constant domains. The four variable domains contain serovar-specific epitopes; the five constant domains are highly conserved among the different serovars and contain several conserved CD4 and CD8 T cell epitopes. MOMP, if its native trimeric structure is preserved, induces protection against *Chlamydia* infection in animals (Kari L et al. *The Journal of Immunology* 2009; 182:8063-70).

Thus, in some embodiments, a *Chlamydia* (e.g., *C. trachomatis*) RNA (e.g., mRNA) vaccine of the present disclosure comprises a RNA polynucleotide encoding any one of, or any combination of at least two of, MOMP serovar H, F, E, D, I, G, J and K.

In some embodiments, a *Chlamydia* (e.g. *C. trachomatis*) RNA (e.g., mRNA) vaccine of the present disclosure comprises at least one RNA polynucleotide encoding major outer membrane protein (MOMP), serovar H.

In some embodiments, a *Chlamydia* (e.g., *C. trachomatis*) RNA (e.g., mRNA) vaccine of the present disclosure comprises at least one RNA polynucleotide encoding MOMP serovar F.

In some embodiments, a *Chlamydia* (e.g., *C. trachomatis*) RNA (e.g., mRNA) vaccine of the present disclosure comprises at least one RNA polynucleotide encoding MOMP serovar E.

In some embodiments, a *Chlamydia* (e.g., *C. trachomatis*) RNA (e.g., mRNA) vaccine of the present disclosure comprises at least one RNA polynucleotide encoding MOMP serovar D.

In some embodiments, a *Chlamydia* (e.g., *C. trachomatis*) RNA (e.g., mRNA) vaccine of the present disclosure comprises at least one RNA polynucleotide encoding MOMP serovar I.

In some embodiments, a *Chlamydia* (e.g., *C. trachomatis*) RNA (e.g., mRNA) vaccine of the present disclosure comprises at least one RNA polynucleotide encoding MOMP serovar G.

In some embodiments, a *Chlamydia* (e.g. *C. trachomatis*) RNA (e.g., mRNA) vaccine of the present disclosure comprises at least one RNA polynucleotide encoding MOMP serovar J.

In some embodiments, a *Chlamydia* (e.g., *C. trachomatis*) RNA (e.g., mRNA) vaccine of the present disclosure comprises at least one RNA polynucleotide encoding MOMP serovar K.

In some embodiments, a *Chlamydia* (e.g., *C. trachomatis*) vaccine may comprise, for example, at least one RNA (e.g., mRNA) encoded by a nucleic acid sequence identified by SEQ ID NO: 62-64 or 184-294 (Table 4 or 8) or a variant thereof having at least 90 identity to a nucleic acid sequence identified by SEQ ID NO: 62-64 or 184-294 (Table 4 or 8).

In some embodiments, a *Chlamydia trachomatis* vaccine may comprise, for example, at least one RNA (e.g., mRNA) encoding an amino acid sequence identified by any one of SEQ ID NO: 65-183 (Tables 5 or 7) or a variant thereof having at least 90 identity to an amino acid sequence identified by any one of SEQ ID NO: 65-183 (Tables 5 or 7).

It should be understood that the present disclosure is not intended to be limited by a particular strain or serotype of *Chlamydia*. The strain or serotype of *Chlamydia* used, as provided herein, may be any strain or serotype of *Chlamydia*, including, for example, *Chlamydia trachomatis*.

In some embodiments, a *Chlamydia* (e.g., *C. trachomatis*) RNA (e.g., mRNA) vaccine of the present disclosure comprises a RNA polynucleotide encoding a variable domain of *Chlamydia* (e.g., *C. trachomatis*) MOMP. In some embodiments, a *Chlamydia* (e.g. *C. trachomatis*) RNA (e.g., mRNA) vaccine of the present disclosure comprises a RNA polynucleotide encoding a serovar-specific epitope of a variable domain of *Chlamydia* (e.g., *C. trachomatis*) MOMP.

In some embodiments, *Chlamydia* vaccines comprise RNA (e.g., mRNA) encoding a *Chlamydia* (e.g., *C. trachomatis*) antigenic polypeptide having at least 95%, at least 96%, at least 97%, at least 98% or at least 99% identity with *Chlamydia* (e.g., *C. trachomatis*) MOMP serovar H, F, E, D, I, G, J and K and having *Chlamydia trachomatis* MOMP serovar H, F, E, D, I, G, J and K activity, respectively.

A protein is considered to have major outer membrane protein (MOMP) activity if, for example, it facilitates porin formation and maintains the structural rigidity of the outer membrane. MOMP permits the diffusion of specific solutes through the intracellular reticulate body membrane. In elementary bodies (EBs, the infectious stage, which is able to survive outside the host cell), MOMP provides the structural integrity of the outer envelope through disulfide cross-links with the small cysteine-rich protein and the large cysteine-rich periplasmic protein. In *Chlamydia trachomatis*, the protein contains four symmetrically-spaced variable domains (VD I-IV). Disulfide bond interactions within and between MOMP molecules and other components form high molecular weight oligomers of the elementary shell. The protein determines the different serotypes and serves as the functional equivalent of peptidogly can.

Herpes Simplex Virus

HSV is a double-stranded, linear DNA virus in the Herpesviridae. Two members of the herpes simplex virus family infect humans—known as HSV-1 and HSV-2. Symptoms of HSV infection include the formation of blisters in the skin or mucous membranes of the mouth, lips and/or genitals. HSV is a neuroinvasive virus that can cause sporadic recurring episodes of viral reactivation in infected individuals. HSV is transmitted by contact with an infected area of the skin during a period of viral activation. HSV most commonly infects via the oral or genital mucosa and replicates in the stratified squamous epithelium, followed by uptake into ramifying unmyelinated sensory nerve fibers within the stratified squamous epithelium. The virus is then transported to the cell body of the neuron in the dorsal root ganglion, where it persists in a latent cellular infection (Cunningham A L et al. J Infect Dis. (2006) 194 (Supplement 1): S11-S18).

The genome of Herpes Simplex Viruses (HSV-1 and HSV-2) contains about 85 open reading frames, such that HSV can generate at least 85 unique proteins. These genes encode 4 major classes of proteins: (1) those associated with the outermost external lipid bilayer of HSV (the envelope), (2) the internal protein coat (the capsid), (3) an intermediate complex connecting the envelope with the capsid coat (the tegument), and (4) proteins responsible for replication and infection.

Examples of envelope proteins include UL1 (gL), UL10 (gM), UL20, UL22, UL27 (gB), UL43, UL44 (gC), UL45, UL49A, UL53 (gK), US4 (gG), US5 (gJ), US6 (gD), US7 (gI), US8 (gE), and US10. Examples of capsid proteins include UL6, UL18, UL19, UL35, and UL38. Tegument proteins include UL11, UL13, UL21, UL36, UL37, UL41, UL45, UL46, UL47, UL48, UL49, US9, and US10. Other HSV proteins include UL2, UL3 UL4, UL5, UL7, UL8, UL9, UL12, UL14, UL15, UL16, UL17, UL23, UL24, UL25, UL26, UL26.5, UL28, UL29, UL30, UL31, UL32, UL33, UL34, UL39, UL40, UL42, UL50, UL51, UL52, UL54, UL55, UL56, US1, US2, US3, US81, US11, US12, ICP0, and ICP4.

Since the envelope (most external portion of an HSV particle) is the first to encounter target cells, the present disclosure encompasses antigenic polypeptides associated with the envelope as immunogenic agents. In brief, surface and membrane proteins—glycoprotein D (gD), glycoprotein B (gB), glycoprotein H (gH), glycoprotein L (gL)—as single antigens or in combination with or without adjuvants may be used as HSV vaccine antigens.

In some embodiments, HSV vaccines comprise RNA (e.g., mRNA) encoding HSV (HSV-1 or HSV-2) glycoprotein D.

In some embodiments, HSV vaccines comprise RNA (e.g., mRNA) encoding HSV (HSV-1 or HSV-2) glycoprotein B.

In some embodiments, HSV vaccines comprise RNA (e.g., mRNA) encoding HSV (HSV-1 or HSV-2) glycoprotein D and glycoprotein C.

In some embodiments, HSV vaccines comprise RNA (e.g., mRNA) encoding HSV (HSV-1 or HSV-2) glycoprotein D and glycoprotein E (or glycoprotein I).

In some embodiments, HSV vaccines comprise RNA (e.g., mRNA) encoding HSV (HSV-1 or HSV-2) glycoprotein B and glycoprotein C.

In some embodiments, HSV vaccines comprise RNA (e.g., mRNA) encoding HSV (HSV-1 or HSV-2) glycoprotein B and glycoprotein E (or glycoprotein I).

In some embodiments, HSV vaccines comprise RNA (e.g., mRNA) encoding a HSV (HSV-1 or HSV-2) antigenic polypeptide having at least 95%, at least 96%, at least 97%, at least 98% or at least 99% identity with HSV (HSV-1 or HSV-2) glycoprotein D and has HSV (HSV-1 or HSV-2) glycoprotein D activity.

In some embodiments, HSV vaccines comprise RNA (e.g., mRNA) encoding a HSV (HSV-1 or HSV-2) antigenic polypeptide having at least 95%, at least 96%, at least 97%, at least 98% or at least 991% identity with HSV (HSV-1 or HSV-2) glycoprotein C and has HSV (HSV-1 or HSV-2) glycoprotein C activity.

In some embodiments, HSV vaccines comprise RNA (e.g., mRNA) encoding a HSV (HSV-1 or HSV-2) antigenic polypeptide having at least 95%, at least 96%, at least 97%, at least 98% or at least 99% identity with HSV (HSV-1 or HSV-2) glycoprotein B and has HSV (HSV-1 or HSV-2) glycoprotein B activity.

In some embodiments, HSV vaccines comprise RNA (e.g., mRNA) encoding a HSV (HSV-1 or HSV-2) antigenic polypeptide having at least 95%, at least 96%, at least 97%, at least 98% or at least 99% identity with HSV (HSV-1 or HSV-2) glycoprotein E and has HSV (HSV-1 or HSV-2) glycoprotein E activity.

In some embodiments, HSV vaccines comprise RNA (e.g., mRNA) encoding a HSV (HSV-1 or HSV-2) antigenic polypeptide having at least 95%, at least 96%, at least 97%, at least 98% or at least 99% identity with HSV (HSV-1 or HSV-2) glycoprotein I and has HSV (HSV-1 or HSV-2) glycoprotein I activity.

Glycoprotein "activity" of the present disclosure is described below.

Glycoprotein C (gC) is a glycoprotein involved in viral attachment to host cells; e.g., it acts as an attachment protein that mediates binding of the HSV-2 virus to host adhesion receptors, namely cell surface heparan sulfate and/or chondroitin sulfate. gC plays a role in host immune evasion (aka viral immunoevasion) by inhibiting the host complement cascade activation. In particular, gC binds to and/or interacts with host complement component C3b; this interaction then inhibits the host immune response by disregulating the complement cascade (e.g., binds host complement C3b to block neutralization of virus).

Glycoprotein D (gD) is an envelope glycoprotein that binds to cell surface receptors and/or is involved in cell attachment via poliovirus receptor-related protein and/or herpesvirus entry mediator, facilitating virus entry. gD binds to the potential host cell entry receptors (tumor necrosis factor receptor superfamily, member 14 (TNFRSF14)/herpesvirus entry mediator (HVEM), poliovirus receptor-related protein 1 (PVRL1) and or poliovirus receptor-related protein 2 (PVRL2) and is proposed to trigger fusion with host membrane, by recruiting the fusion machinery composed of, for example, gB and gH/gL. gD interacts with host cell receptors TNFRSF14 and/or PVRL1 and/or PVRL2 and (1) interacts (via profusion domain) with gB; an interaction which can occur in the absence of related HSV glycoproteins. e.g., gH and/or gL; and (2) gD interacts (via profusion domain) with gH/gL heterodimer, an interaction which can occur in the absence of gB. As such, gD associates with the gB-gH/gL-gD complex. gD also interacts (via C-terminus) with UL11 tegument protein.

Glycoprotein B (gB) is a viral glycoprotein involved in the viral cell activity of herpes simplex virus (HSV) and is required for the fusion of the HSV's envelope with the cellular membrane. It is the most highly conserved of all surface glycoproteins and primarily acts as a fusion protein, constituting the core fusion machinery. gB, a class III membrane fusion glycoprotein, is a type-1 transmembrane protein trimer of five structural domains. Domain I includes two internal fusion loops and is through to insert into the cellular membrane during virus-cell fusion. Domain II appears to interact with gH/gL during the fusion process, domain III contains an elongated alpha helix, and domain IV interacts with cellular receptors.

In epithelial cells, the heterodimer glycoprotein E/glycoproteinI (gE/gI) is required for the cell-to-cell spread of the virus, by sorting nascent virions to cell junctions. Once the virus reaches the cell junctions, virus particles can spread to adjacent cells extremely rapidly through interactions with cellular receptors that accumulate at these junctions. By similarity, it is implicated in basolateral spread in polarized cells. In neuronal cells, gE/gI is essential for the anterograde spread of the infection throughout the host nervous system. Together with US9, the heterodimer gE/gI is involved in the sorting and transport of viral structural components toward axon tips. The heterodimer gE/gI serves as a receptor for the Fc part of host IgG. Dissociation of gE/gI from IgG occurs at acidic pH, thus may be involved in anti-HSV antibodies bipolar bridging, followed by intracellular endocytosis and degradation, thereby interfering with host IgG-mediated immune responses. gE/gI interacts (via C-terminus) with VP22 tegument protein; this interaction is necessary for the recruitment of VP22 to the Golgi and its packaging into virions.

Combination Vaccines

Embodiments of the present disclosure also provide combination RNA (e.g., mRNA) vaccines. A "combination RNA (e.g., mRNA) vaccine" of the present disclosure refers to a vaccine comprising at least one (e.g., at least 2, 3, 4, or 5) RNA (e.g., mRNA) polynucleotide having an open reading frame encoding a combination of at least one HPV antigenic polypeptide (e.g., selected from E1, E2, E4, E5, E6, E7, L1, and L2), at least one HSV antigenic polypeptide (e.g., selected from glycoprotein D, glycoprotein B, glycoprotein C, and glycoprotein E), at least one Chlamydia antigenic polypeptide (e.g., selected from MOMP serovar H, F, E, D, I, G, J and K), or any combination of two or more of the foregoing antigenic polypeptides.

It has been discovered that the mRNA vaccines described herein are superior to current vaccines in several ways. First, the lipid nanoparticle (LNP) delivery is superior to other formulations including a protamine base approach described in the literature and no additional adjuvants are to be necessary. The use of LNPs enables the effective delivery of chemically modified or unmodified mRNA vaccines. Additionally it has been demonstrated herein that both modified and unmodified LNP formulated mRNA vaccines were superior to conventional vaccines by a significant degree. In some embodiments the mRNA vaccines of the invention are superior to conventional vaccines by a factor of at least 10 fold, 20 fold, 40 fold, 50 fold, 100 fold, 500 fold or 1,000 fold.

Although attempts have been made to produce functional RNA vaccines, including mRNA vaccines and self-replicating RNA vaccines, the therapeutic efficacy of these RNA vaccines have not yet been fully established. Quite surprisingly, the inventors have discovered, according to aspects of the invention a class of formulations for delivering mRNA vaccines in vivo that results in significantly enhanced, and in many respects synergistic, immune responses including enhanced antigen generation and functional antibody production with neutralization capability. These results can be achieved even when significantly lower doses of the mRNA are administered in comparison with mRNA doses used in other classes of lipid based formulations. The formulations of the invention have demonstrated significant unexpected in vivo immune responses sufficient to establish the efficacy of functional mRNA vaccines as prophylactic and therapeutic agents. Additionally, self-replicating RNA vaccines rely on viral replication pathways to deliver enough RNA to a cell to produce an immunogenic response. The formulations of the invention do not require viral replication to produce enough protein to result in a strong immune response. Thus, the mRNA of the invention are not self-replicating RNA and do not include components necessary for viral replication.

The invention involves, in some aspects, the surprising finding that lipid nanoparticle (LNP) formulations significantly enhance the effectiveness of mRNA vaccines, including chemically modified and unmodified mRNA vaccines. The efficacy of mRNA vaccines formulated in LNP was examined in vivo using several distinct antigens. The results presented herein demonstrate the unexpected superior efficacy of the mRNA vaccines formulated in LNP over other commercially available vaccines.

In addition to providing an enhanced immune response, the formulations of the invention generate a more rapid immune response with fewer doses of antigen than other vaccines tested. The mRNA-LNP formulations of the invention also produce quantitatively and qualitatively better immune responses than vaccines formulated in a different carriers.

The LNP used in the studies described herein has been used previously to deliver siRNA in various animal models as well as in humans. In view of the observations made in association with the siRNA delivery of LNP formulations, the fact that LNP is useful in vaccines is quite surprising. It has been observed that therapeutic delivery of siRNA formulated in LNP causes an undesirable inflammatory response associated with a transient IgM response, typically leading to a reduction in antigen production and a compromised immune response. In contrast to the findings observed with siRNA, the LNP-mRNA formulations of the invention are demonstrated herein to generate enhanced IgG levels, sufficient for prophylactic and therapeutic methods rather than transient IgM responses.

Nucleic Acids/Polynucleotides

STD vaccines, as provided herein, comprise at least one (one or more) ribonucleic acid (RNA) (e.g., mRNA) polynucleotide having an open reading frame encoding at least one HPV antigenic polypeptide, at least one HSV antigenic polypeptide, and/or at least one *Chlamydia* (e.g., *C. trachomatis*) antigenic polypeptide. The term "nucleic acid" includes any compound and/or substance that comprises a polymer of nucleotides (nucleotide monomer). These polymers are referred to as polynucleotides. Thus, the terms "nucleic acid" and "polynucleotide" are used interchangeably.

Nucleic acids may be or may include, for example, ribonucleic acids (RNAs), deoxyribonucleic acids (DNAs), threose nucleic acids (TNAs), glycol nucleic acids (GNAs), peptide nucleic acids (PNAs), locked nucleic acids (LNAs, including LNA having a β-D-ribo configuration, α-LNA having an α-L-ribo configuration (a diastereomer of LNA), 2'-amino-LNA having a 2'-amino functionalization, and 2'-amino-α-LNA having a 2'-amino functionalization), ethylene nucleic acids (ENA), cyclohexenyl nucleic acids (CeNA) or chimeras or combinations thereof.

In some embodiments, polynucleotides of the present disclosure function as messenger RNA (mRNA). "Messenger RNA" (mRNA) refers to any polynucleotide that encodes a (at least one) polypeptide (a naturally-occurring, non-naturally-occurring, or modified polymer of amino acids) and can be translated to produce the encoded polypeptide in vitro, in vivo, in situ or ex vivo. The skilled artisan will appreciate that, except where otherwise noted, polynucleotide sequences set forth in the instant application will recite "T"s in a representative DNA sequence but where the sequence represents RNA (e.g., mRNA), the "T"s would be substituted for "U"s. Thus, any of the RNA polynucleotides encoded by a DNA identified by a particular sequence identification number may also comprise the corresponding RNA (e.g., mRNA) sequence encoded by the DNA, where each "T" of the DNA sequence is substituted with "U."

The basic components of an mRNA molecule typically include at least one coding region, a 5' untranslated region (UTR), a 3' UTR, a 5' cap and a poly-A tail. Polynucleotides of the present disclosure may function as mRNA but can be distinguished from wild-type mRNA in their functional and/or structural design features, which serve to overcome existing problems of effective polypeptide expression using nucleic-acid based therapeutics.

In some embodiments, a RNA polynucleotide of an RNA (e.g., mRNA) vaccine encodes 2-10, 2-9, 2-8, 2-7, 2-6, 2-5, 2-4, 2-3, 3-10, 3-9, 3-8, 3-7, 3-6, 3-5, 3-4, 4-10, 4-9, 4-8, 4-7, 4-6, 4-5, 5-10, 5-9, 5-8, 5-7, 5-6, 6-10, 6-9, 6-8, 6-7, 7-10, 7-9, 7-8, 8-10, 8-9 or 9-10 antigenic polypeptides. In some embodiments, a RNA (e.g., mRNA) polynucleotide of a STD vaccine encodes at least 10, 20, 30, 40, 50, 60, 70, 80, 90 or 100 antigenic polypeptides. In some embodiments, a RNA (e.g., mRNA) polynucleotide of a STD vaccine encodes at least 100 or at least 200 antigenic polypeptides. In some embodiments, a RNA polynucleotide of an STD vaccine encodes 1-10, 5-15, 10-20, 15-25, 20-30, 25-35, 30-40, 35-45, 40-50, 1-50, 1-100, 2-50 or 2-100 antigenic polypeptides.

Polynucleotides of the present disclosure, in some embodiments, are codon optimized. Codon optimization methods are known in the art and may be used as provided herein. Codon optimization, in some embodiments, may be used to match codon frequencies in target and host organisms to ensure proper folding; bias GC content to increase mRNA stability or reduce secondary structures; minimize tandem repeat codons or base runs that may impair gene construction or expression; customize transcriptional and translational control regions; insert or remove protein trafficking sequences; remove/add post translation modification sites in encoded protein (e.g. glycosylation sites); add, remove or shuffle protein domains; insert or delete restriction sites; modify ribosome binding sites and mRNA degradation sites; adjust translational rates to allow the various domains of the protein to fold properly; or to reduce or eliminate problem secondary structures within the polynucleotide. Codon optimization tools, algorithms and services are known in the art—non-limiting examples include services from GeneArt (Life Technologies), DNA2.0 (Menlo Park Calif.) and/or proprietary methods. In some embodiments, the open reading frame (ORF) sequence is optimized using optimization algorithms.

In some embodiments, a codon optimized sequence shares less than 95% sequence identity, less than 90% sequence identity, less than 85% sequence identity, less than 80% sequence identity, or less than 75% sequence identity to a naturally-occurring or wild-type sequence (e.g., a naturally-occurring or wild-type mRNA sequence encoding a polypeptide or protein of interest (e.g., an antigenic protein or antigenic polypeptide)).

In some embodiments, a codon-optimized sequence shares between 65% and 85% (e.g., between about 67% and about 85%, or between about 67% and about 80%) sequence identity to a naturally-occurring sequence or a wild-type sequence (e.g., a naturally-occurring or wild-type mRNA sequence encoding a polypeptide or protein of interest (e.g., an antigenic protein or polypeptide)). In some embodiments, a codon-optimized sequence shares between 65% and 75%, or about 80% sequence identity to a naturally-occurring sequence or wild-type sequence (e.g., a naturally-occurring or wild-type mRNA sequence encoding a polypeptide or protein of interest (e.g., an antigenic protein or polypeptide)).

In some embodiments a codon-optimized RNA (e.g., mRNA) may, for instance, be one in which the levels of G/C are enhanced. The G/C-content of nucleic acid molecules may influence the stability of the RNA. RNA having an increased amount of guanine (G) and/or cytosine (C) residues may be functionally more stable than nucleic acids containing a large amount of adenine (A) and thymine (T) or uracil (U) nucleotides. WO02/098443 discloses a pharmaceutical composition containing an mRNA stabilized by sequence modifications in the translated region. Due to the degeneracy of the genetic code, the modifications work by substituting existing codons for those that promote greater RNA stability without changing the resulting amino acid. The approach is limited to coding regions of the RNA.

Antigens/Antigenic Polypeptides

In some embodiments, an antigenic polypeptide (e.g., HPV, HSV and/or *Chlamydia* antigenic polypeptide) is longer than 25 amino acids and shorter than 50 amino acids. Polypeptides include gene products, naturally occurring polypeptides, synthetic polypeptides, homologs, orthologs, paralogs, fragments and other equivalents, variants, and analogs of the foregoing. A polypeptide may be a single molecule or may be a multi-molecular complex such as a dimer, trimer or tetramer. Polypeptides may also comprise single chain polypeptides or multichain polypeptides, such as antibodies or insulin, and may be associated or linked to each other. Most commonly, disulfide linkages are found in multichain polypeptides. The term "polypeptide" may also apply to amino acid polymers in which at least one amino acid residue is an artificial chemical analogue of a corresponding naturally-occurring amino acid.

A "polypeptide variant" is a molecule that differs in its amino acid sequence relative to a native sequence or a reference sequence. Amino acid sequence variants may possess substitutions, deletions, insertions, or a combination of any two or three of the foregoing, at certain positions within the amino acid sequence, as compared to a native sequence or a reference sequence. Ordinarily, variants possess at least 50% identity to a native sequence or a reference sequence. In some embodiments, variants share at least 80% identity or at least 90% identity with a native sequence or a reference sequence.

In some embodiments "variant mimics" are provided. A "variant mimic" contains at least one amino acid that would mimic an activated sequence. For example, glutamate may serve as a mimic for phosphoro-threonine and/or phosphoro-serine. Alternatively, variant mimics may result in deactivation or in an inactivated product containing the mimic. For example, phenylalanine may act as an inactivating substitution for tyrosine, or alanine may act as an inactivating substitution for serine.

"Orthologs" refers to genes in different species that evolved from a common ancestral gene by speciation. Normally, orthologs retain the same function in the course of evolution. Identification of orthologs is important for reliable prediction of gene function in newly sequenced genomes.

"Analogs" is meant to include polypeptide variants that differ by one or more amino acid alterations, for example, substitutions, additions or deletions of amino acid residues that still maintain one or more of the properties of the parent or starting polypeptide.

The present disclosure provides several types of compositions that are polynucleotide or polypeptide based, including variants and derivatives. These include, for example, substitutional, insertional, deletion and covalent variants and derivatives. The term "derivative" is synonymous with the term "variant" and generally refers to a molecule that has been modified and/or changed in any way relative to a reference molecule or a starting molecule.

As such, polynucleotides encoding peptides or polypeptides containing substitutions, insertions and/or additions, deletions and covalent modifications with respect to reference sequences, in particular the polypeptide sequences disclosed herein, are included within the scope of this disclosure. For example, sequence tags or amino acids, such as one or more lysines, can be added to peptide sequences (e.g., at the N-terminal or C-terminal ends). Sequence tags can be used for peptide detection, purification or localization. Lysines can be used to increase peptide solubility or to allow for biotinylation. Alternatively, amino acid residues located at the carboxy and amino terminal regions of the amino acid sequence of a peptide or protein may optionally be deleted providing for truncated sequences. Certain amino acids (e.g., C-terminal residues or N-terminal residues) alternatively may be deleted depending on the use of the sequence, as for example, expression of the sequence as part of a larger sequence that is soluble, or linked to a solid support.

"Substitutional variants" when referring to polypeptides are those that have at least one amino acid residue in a native or starting sequence removed and a different amino acid inserted in its place at the same position. Substitutions may be single, where only one amino acid in the molecule has been substituted, or they may be multiple, where two or more (e.g., 3, 4 or 5) amino acids have been substituted in the same molecule.

As used herein the term "conservative amino acid substitution" refers to the substitution of an amino acid that is normally present in the sequence with a different amino acid of similar size, charge, or polarity. Examples of conservative substitutions include the substitution of a non-polar (hydrophobic) residue such as isoleucine, valine and leucine for another non-polar residue. Likewise, examples of conservative substitutions include the substitution of one polar (hydrophilic) residue for another such as between arginine and lysine, between glutamine and asparagine, and between glycine and serine. Additionally, the substitution of a basic residue such as lysine, arginine or histidine for another, or the substitution of one acidic residue such as aspartic acid or glutamic acid for another acidic residue are additional examples of conservative substitutions. Examples of non-conservative substitutions include the substitution of a non-polar (hydrophobic) amino acid residue such as isoleucine, valine, leucine, alanine, methionine for a polar (hydrophilic) residue such as cysteine, glutamine, glutamic acid or lysine and/or a polar residue for a non-polar residue.

"Features" when referring to polypeptide or polynucleotide are defined as distinct amino acid sequence-based or nucleotide-based components of a molecule respectively. Features of the polypeptides encoded by the polynucleotides include surface manifestations, local conformational shape, folds, loops, half-loops, domains, half-domains, sites, termini and any combination(s) thereof.

As used herein when referring to polypeptides the term "domain" refers to a motif of a polypeptide having one or more identifiable structural or functional characteristics or properties (e.g., binding capacity, serving as a site for protein-protein interactions).

As used herein when referring to polypeptides the terms "site" as it pertains to amino acid based embodiments is used synonymously with "amino acid residue" and "amino acid side chain." As used herein when referring to polynucleotides the terms "site" as it pertains to nucleotide based embodiments is used synonymously with "nucleotide." A site represents a position within a peptide or polypeptide or polynucleotide that may be modified, manipulated, altered, derivatized or varied within the polypeptide-based or polynucleotide-based molecules.

As used herein the terms "termini" or "terminus" when referring to polypeptides or polynucleotides refers to an extremity of a polypeptide or polynucleotide respectively. Such extremity is not limited only to the first or final site of the polypeptide or polynucleotide but may include additional amino acids or nucleotides in the terminal regions. Polypeptide-based molecules may be characterized as having both an N-terminus (terminated by an amino acid with a free amino group (NH2)) and a C-terminus (terminated by an amino acid with a free carboxyl group (COOH)). Proteins are in some cases made up of multiple polypeptide chains brought together by disulfide bonds or by non-covalent forces (multimers, oligomers). These proteins have multiple N- and C-termini. Alternatively, the termini of the polypeptides may be modified such that they begin or end, as the case may be, with a non-polypeptide based moiety such as an organic conjugate.

As recognized by those skilled in the art, protein fragments, functional protein domains, and homologous proteins are also considered to be within the scope of polypeptides of interest. For example, provided herein is any protein fragment (meaning a polypeptide sequence at least one amino acid residue shorter than a reference polypeptide sequence but otherwise identical) of a reference protein having a length of 10, 20, 30, 40, 50, 60, 70, 80, 90, 100 or longer than 100 amino acids. In another example, any protein that includes a stretch of 20, 30, 40, 50, or 100 (contiguous) amino acids that are 40%, 50%, 60%, 70%, 80%, 90%, 95%, or 100% identical to any of the sequences described herein can be utilized in accordance with the disclosure. In some embodiments, a polypeptide includes 2, 3, 4, 5, 6, 7, 8, 9, 10, or more mutations as shown in any of the sequences provided herein or referenced herein. In another example, any protein that includes a stretch of 20, 30, 40, 50, or 100 amino acids that are greater than 80%, 90%, 95%, or 100% identical to any of the sequences described herein, wherein the protein has a stretch of 5, 10, 15, 20, 25, or 30 amino acids that are less than 80%, 75%, 70%, 65% to 60% identical to any of the sequences described herein can be utilized in accordance with the disclosure.

Polypeptide or polynucleotide molecules of the present disclosure may share a certain degree of sequence similarity or identity with the reference molecules (e.g., reference polypeptides or reference polynucleotides), for example, with art-described molecules (e.g., engineered or designed molecules or wild-type molecules). The term "identity," as known in the art, refers to a relationship between the sequences of two or more polypeptides or polynucleotides, as determined by comparing the sequences. In the art, identity also means the degree of sequence relatedness between two sequences as determined by the number of matches between strings of two or more amino acid residues or nucleic acid residues. Identity measures the percent of identical matches between the smaller of two or more sequences with gap alignments (if any) addressed by a particular mathematical model or computer program (e.g., "algorithms"). Identity of related peptides can be readily calculated by known methods. "% identity" as it applies to polypeptide or polynucleotide sequences is defined as the percentage of residues (amino acid residues or nucleic acid residues) in the candidate amino acid or nucleic acid sequence that are identical with the residues in the amino acid sequence or nucleic acid sequence of a second sequence after aligning the sequences and introducing gaps, if necessary, to achieve the maximum percent identity. Methods and computer programs for the alignment are well known in the art. Identity depends on a calculation of percent identity but may differ in value due to gaps and penalties introduced in the calculation. Generally, variants of a particular polynucleotide or polypeptide have at least 40%, 45%, 50%, 55%, 60%, 65%, 70%, 75%, 80%, 85%, 90%, 91%, 92%, 939%, 94%, 95%, 96%, 97%, 98%, 99% but less than 100% sequence identity to that particular reference polynucleotide or polypeptide as determined by sequence alignment programs and parameters described herein and known to those skilled in the art. Such tools for alignment include those of the BLAST suite (Stephen F. Altschul, et al. (1997). "Gapped BLAST and PSI-BLAST: a new generation of protein database search programs," *Nucleic Acids Res.* 25:3389-3402). Another popular local alignment technique is based on the Smith-Waterman algorithm (Smith, T. F. & Waterman, M. S. (1981) "Identification of common molecular subsequences." *J. Mol. Biol.* 147:195-197). A general global alignment technique based on dynamic programming is the Needleman-Wunsch algorithm (Needleman, S. B. & Wunsch, C. D. (1970) "A general method applicable to the search for similarities in the amino acid sequences of two proteins." *J. Mol. Biol.* 48:443-453). More recently, a Fast Optimal Global Sequence Alignment Algorithm (FOGSAA) was developed that purportedly produces global alignment of nucleotide and protein sequences faster than other optimal global alignment methods, including the Needleman-Wunsch algorithm. Other tools are described herein, specifically in the definition of "identity" below.

As used herein, the term "homology" refers to the overall relatedness between polymeric molecules, e.g. between nucleic acid molecules (e.g. DNA molecules and/or RNA molecules) and/or between polypeptide molecules. Polymeric molecules (e.g. nucleic acid molecules (e.g. DNA molecules and/or RNA molecules) and/or polypeptide molecules) that share a threshold level of similarity or identity determined by alignment of matching residues are termed homologous. Homology is a qualitative term that describes a relationship between molecules and can be based upon the quantitative similarity or identity. Similarity or identity is a quantitative term that defines the degree of sequence match between two compared sequences. In some embodiments, polymeric molecules are considered to be "homologous" to one another if their sequences are at least 25%, 30%, 35%, 40%, 45%, 50%, 55%, 60%, 65%, 70%, 75%, 80%, 85%, 90%, 95%, or 99% identical or similar. The term "homologous" necessarily refers to a comparison between at least two sequences (polynucleotide or polypeptide sequences). Two polynucleotide sequences are considered homologous if the polypeptides they encode are at least 50%, 60%, 70%, 80%, 90%, 95%, or even 99% for at least one stretch of at least 20 amino acids. In some embodiments, homologous polynucleotide sequences are characterized by the ability to encode a stretch of at least 4-5 uniquely specified amino acids. For polynucleotide sequences less than 60 nucleotides in length, homology is determined by the ability to encode a stretch of at least 4-5 uniquely specified amino acids. Two protein sequences are considered homologous if the proteins are at least 50%, 60%, 70%, 80%, or 90% identical for at least one stretch of at least 20 amino acids.

Homology implies that the compared sequences diverged in evolution from a common origin. The term "homolog" refers to a first amino acid sequence or nucleic acid sequence (e.g., gene (DNA or RNA) or protein sequence) that is related to a second amino acid sequence or nucleic acid sequence by descent from a common ancestral sequence. The term "homolog" may apply to the relationship between genes and/or proteins separated by the event of speciation or to the relationship between genes and/or proteins separated by the event of genetic duplication. "Orthologs" are genes (or proteins) in different species that evolved from a common ancestral gene (or protein) by speciation. Typically, orthologs retain the same function in the course of evolution. "Paralogs" are genes (or proteins) related by duplication within a genome. Orthologs retain the same function in the course of evolution, whereas paralogs evolve new functions, even if these are related to the original one.

The term "identity" refers to the overall relatedness between polymeric molecules, for example, between polynucleotide molecules (e.g. DNA molecules and/or RNA molecules) and/or between polypeptide molecules. Calculation of the percent identity of two polynucleic acid sequences, for example, can be performed by aligning the two sequences for optimal comparison purposes (e.g., gaps can be introduced in one or both of a first and a second nucleic acid sequences for optimal alignment and non-identical sequences can be disregarded for comparison purposes). In certain embodiments, the length of a sequence aligned for comparison purposes is at least 30%, at least 40%, at least 50%, at least 60%, at least 70%, at least 80%, at least 90%, at least 95%, or 100% of the length of the reference sequence. The nucleotides at corresponding nucleotide positions are then compared. When a position in the first sequence is occupied by the same nucleotide as the corresponding position in the second sequence, then the molecules are identical at that position. The percent identity between the two sequences is a function of the number of identical positions shared by the sequences, taking into account the number of gaps, and the length of each gap, which needs to be introduced for optimal alignment of the two sequences. The comparison of sequences and determination of percent identity between two sequences can be accomplished using a mathematical algorithm. For example, the percent identity between two nucleic acid sequences can be determined using methods such as those described in Computational Molecular Biology. Lesk, A. M., ed., Oxford University Press, New York, 1988; Biocomputing: Informatics and Genome Projects. Smith. D. W., ed., Academic Press, New York, 1993; Sequence Analysis in Molecular Biology, von Heinje, G., Academic Press, 1987; Computer Analysis of Sequence Data, Part I, Griffin, A. M., and Griffin, H. G., eds., Humana Press, New Jersey, 1994; and Sequence Analysis Primer, Gribskov, M, and Devereux, J., eds., M Stockton Press, New York, 1991; each of which is incorporated herein by reference. For example, the percent identity between two nucleic acid sequences can be determined using the algorithm of Meyers and Miller (CABIOS, 1989, 4:11-17), which has been incorporated into the ALIGN program (version 2.0) using a PAM120 weight residue table, a gap length penalty of 12 and a gap penalty of 4. The percent identity between two nucleic acid sequences can, alternatively, be determined using the GAP program in the GCG software package using an NWSgapdna.CMP matrix. Methods commonly employed to determine percent identity between sequences include, but are not limited to those disclosed in Carillo. H., and Lipman, D., SIAM *J Applied Math.,* 48:1073 (1988); incorporated herein by reference. Techniques for determining identity are codified in publicly available computer programs. Exemplary computer software to determine homology between two sequences include, but are not limited to, GCG program package, Devereux, J., et al., *Nucleic Acids Research,* 12, 387 (1984)), BLASTP, BLASTN, and FASTA Altschul, S. F. et al., *J. Molec. Biol.,* 215, 403 (1990)).

Multiprotein and Multicomponent Vaccines

The present disclosure encompasses STD vaccines comprising multiple RNA (e.g., mRNA) polynucleotides, each encoding a single antigenic polypeptide, as well as STD vaccines comprising a single RNA polynucleotide encoding more than one antigenic polypeptide (e.g., as a fusion polypeptide). Thus, a vaccine composition comprising a RNA (e.g., mRNA) pol nucleotide having an open reading frame encoding a first antigenic polypeptide and a RNA (e.g., mRNA) polynucleotide having an open reading frame encoding a second antigenic polypeptide encompasses (a) vaccines that comprise a first RNA polynucleotide encoding a first antigenic polypeptide and a second RNA polynucleotide encoding a second antigenic polypeptide, and (b) vaccines that comprise a single RNA polynucleotide encoding a first and second antigenic polypeptide (e.g., as a fusion polypeptide). RNA (e.g., mRNA) vaccines of the present disclosure, in some embodiments, comprise 2-10 (e.g., 2, 3, 4, 5, 6, 7, 8, 9 or 10), or more, RNA polynucleotides having an open reading frame, each of which encodes a different antigenic polypeptide (or a single RNA polynucleotide encoding 2-10, or more, different antigenic polypeptides). The antigenic polypeptides may be selected from HPV antigenic polypeptides, HSV antigenic polypeptides, and *Chlamydia* (e.g., *C. trachomatis*) antigenic polypeptides.

In some embodiments, a STD vaccine comprises a RNA (e.g., mRNA) polynucleotide having an open reading frame encoding a viral capsid protein, a RNA (e.g., mRNA) polynucleotide having an open reading frame encoding a viral premembrane/membrane protein, and a RNA (e.g., mRNA) polynucleotide having an open reading frame encoding a viral envelope protein. In some embodiments, a STD vaccine comprises a RNA (e.g., mRNA) polynucleotide having an open reading frame encoding a viral fusion (F) protein and a RNA polynucleotide having an open reading frame encoding a viral major surface glycoprotein (G protein). In some embodiments, a vaccine comprises a RNA (e.g., mRNA) polynucleotide having an open reading frame encoding a viral F protein. In some embodiments, a vaccine comprises a RNA (e.g., mRNA) polynucleotide having an open reading frame encoding a viral G protein. In some embodiments, a vaccine comprises a RNA (e.g., mRNA) polynucleotide having an open reading frame encoding a HN protein.

In some embodiments, a multicomponent vaccine comprises at least one RNA (e.g., mRNA) polynucleotide encoding at least one antigenic polypeptide fused to a signal peptide (e.g., SEQ ID NO: 304-307). The signal peptide may be fused at the N-terminus or the C-terminus of an antigenic polypeptide. An antigenic polypeptide fused to a signal peptide may be selected from HPV antigenic polypeptides. HSV antigenic polypeptides, and *Chlamydia* (e.g., *C. trachomatis*) antigenic polypeptides.

Signal Peptides and Leader Sequences

In some embodiments, antigenic polypeptides encoded by STD RNA (e.g., mRNA) polynucleotides comprise a signal peptide. Signal peptides, comprising the N-terminal 15-60 amino acids of proteins, are typically needed for the translocation across the membrane on the secretory pathway and, thus, universally control the entry of most proteins both in eukaryotes and prokaryotes to the secretory pathway. Signal peptides generally include three regions, an N-terminal region of differing length, which usually comprises positively charged amino acids; a hydrophobic region; and a short carboxy-terminal peptide region. In eukaryotes, the signal peptide of a nascent precursor protein (pre-protein) directs the ribosome to the rough endoplasmic reticulum (ER) membrane and initiates the transport of the growing peptide chain across it for processing. ER processing produces mature proteins, wherein the signal peptide is cleaved from precursor proteins, typically by a ER-resident signal peptidase of the host cell, or they remain uncleaved and function as a membrane anchor. A signal peptide may also facilitate the targeting of the protein to the cell membrane. The signal peptide, however, is not responsible for the final destination of the mature protein. Secretory proteins devoid of additional address tags in their sequence are by default secreted to the external environment. During recent years, a more advanced view of signal peptides has evolved, showing that the functions and immunodominance of certain signal peptides are much more versatile than previously anticipated.

In some embodiments, a *Chlamydia* antigenic polypeptide may be comprise a leader sequence to facilitate cell surface expression of the antigenic polypeptide. In some embodiments, a *Chlamydia trachomatis* MOMP antigenic polypeptide comprises a leader sequence that facilitates cell surface expression of the MOMP. See, e.g., Jones H M, et al. *Gene.* 2000, 258: 173-181; and Findlay H E, et al. *BMC Microbiology.* 2005, 5:5. In some embodiments, a *Chlamydia* trachomatis antigenic polypeptide (e.g., a MOMP antigenic polypeptide) comprises (is linked to) a leader sequence comprising an amino acid identified by any one of SEQ ID NO: 301-316. It should be understood that any antigenic polypeptide (e.g., HPV, HSV and/or *Chlamydia* antigenic polypeptide) as provided herein may comprise a leader sequence.

STD vaccines of the present disclosure may comprise, for example, RNA (e.g., mRNA) polynucleotides encoding an artificial signal peptide, wherein the signal peptide coding sequence is operably linked to and is in frame with the coding sequence of the antigenic polypeptide. Thus, STD vaccines of the present disclosure, in some embodiments, produce an antigenic polypeptide (e.g., a HPV antigenic polypeptide. HSV antigenic polypeptides and/or a *Chlamydia* antigenic polypeptide) fused to a signal peptide. In some embodiments, a signal peptide is fused to the N-terminus of the antigenic polypeptide. In some embodiments, a signal peptide is fused to the C-terminus of the antigenic polypeptide.

In some embodiments, the signal peptide fused to the antigenic polypeptide is an artificial signal peptide. In some embodiments, an artificial signal peptide fused to the antigenic polypeptide encoded by the RNA (e.g., mRNA) vaccine is obtained from an immunoglobulin protein, e.g., an IgE signal peptide or an IgG signal peptide. In some embodiments, a signal peptide fused to the antigenic polypeptide encoded by a RNA (e.g., mRNA) vaccine is an Ig heavy chain epsilon-1 signal peptide (IgE HC SP) having the sequence of: MDWTWILFLVAAATRVHS; SEQ ID NO: 305. In some embodiments, a signal peptide fused to the antigenic polypeptide encoded by the (e.g., mRNA) RNA (e.g., mRNA) vaccine is an IgGk chain V-III region HAH signal peptide (IgGk SP) having the sequence of METPAQLLFLLLLWLPDTTG; SEQ ID NO: 304. In some embodiments, the signal peptide is selected from: Japanese encephalitis PRM signal sequence (MLGSNSGQRVVFTILLLLVAPAYS; SEQ ID NO: 306), VSVg protein signal sequence (MKCLLYLAFLFIGVNCA SEQ ID NO: 307) and Japanese encephalitis JEV signal sequence (MWLVSLAIVTACAGA; SEQ ID NO: 308).

In some embodiments, the antigenic polypeptide encoded by a RNA (e.g., mRNA) vaccine comprises an amino acid sequence identified by any one of 8, 12-14, 24-34, 47-50 or 54-56 (Tables 3, 6, 11, 14 or 17; see also amino acid sequences of Tables 4, 7, 12 or 15) fused to a signal peptide identified by any one of −19 (Table 8). The examples disclosed herein are not meant to be limiting and any signal peptide that is known in the art to facilitate targeting of a protein to ER for processing and/or targeting of a protein to the cell membrane may be used in accordance with the present disclosure.

A signal peptide may have a length of 15-60 amino acids. For example, a signal peptide may have a length of 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, or 60 amino acids. In some embodiments, a signal peptide has a length of 20-60, 25-60, 30-60, 35-60, 40-60, 45-60, 50-60, 55-60, 15-55, 20-55, 25-55, 30-55, 35-55, 40-55, 45-55, 50-55, 15-50, 20-50, 25-50, 30-50, 35-50, 40-50, 45-50, 15-45, 20-45, 25-45, 30-45, 35-45, 40-45, 15-40, 20-40, 25-40, 30-40, 35-40, 15-35, 20-35, 25-35, 30-35, 15-30, 20-30, 25-30, 15-25, 20-25, or 15-20 amino acids.

A signal peptide is typically cleaved from the nascent polypeptide at the cleavage junction during ER processing. The mature antigenic polypeptide produce by a STD RNA (e.g., mRNA) vaccine of the present disclosure typically does not comprise a signal peptide.

Chemical Modifications

STD vaccines of the present disclosure, in some embodiments, comprise at least RNA (e.g. mRNA) polynucleotide having an open reading frame encoding at least one antigenic polypeptide that comprises at least one chemical modification.

The terms "chemical modification" and "chemically modified" refer to modification with respect to adenosine (A), guanosine (G), uridine (U), thymidine (T) or cytidine (C) ribonucleosides or deoxyribonucleosides in at least one of their position, pattern, percent or population. Generally, these terms do not refer to the ribonucleotide modifications in naturally occurring 5'-terminal mRNA cap moieties. With respect to a polypeptide, the term "modification" refers to a modification relative to the canonical set 20 amino acids. Polypeptides, as provided herein, are also considered "modified" of they contain amino acid substitutions, insertions or a combination of substitutions and insertions.

Polynucleotides (e.g., RNA polynucleotides, such as mRNA polynucleotides), in some embodiments, comprise various (more than one) different modifications. In some embodiments, a particular region of a polynucleotide contains one, two or more (optionally different) nucleoside or nucleotide modifications. In some embodiments, a modified RNA polynucleotide (e.g., a modified mRNA polynucleotide), introduced to a cell or organism, exhibits reduced degradation in the cell or organism, respectively, relative to an unmodified polynucleotide. In some embodiments, a modified RNA polynucleotide (e.g., a modified mRNA polynucleotide), introduced into a cell or organism, may exhibit reduced immunogenicity in the cell or organism, respectively (e.g., a reduced innate response).

Modifications of polynucleotides include, without limitation, those described herein. Polynucleotides (e.g., RNA polynucleotides, such as mRNA polynucleotides) may comprise modifications that are naturally-occurring, non-naturally-occurring or the polynucleotide may comprise a combination of naturally-occurring and non-naturally-occurring modifications. Polynucleotides may include any useful modification, for example, of a sugar, a nucleobase, or an internucleoside linkage (e.g., to a linking phosphate, to a phosphodiester linkage or to the phosphodiester backbone).

Polynucleotides (e.g., RNA polynucleotides, such as mRNA polynucleotides), in some embodiments, comprise non-natural modified nucleotides that are introduced during synthesis or post-synthesis of the polynucleotides to achieve desired functions or properties. The modifications may be present on an internucleotide linkages, purine or pyrimidine bases, or sugars. The modification may be introduced with chemical synthesis or with a polymerase enzyme at the terminal of a chain or anywhere else in the chain. Any of the regions of a polynucleotide may be chemically modified.

The present disclosure provides for modified nucleosides and nucleotides of a polynucleotide (e.g., RNA polynucleotides, such as mRNA polynucleotides). A "nucleoside" refers to a compound containing a sugar molecule (e.g., a pentose or ribose) or a derivative thereof in combination with an organic base (e.g., a purine or pyrimidine) or a derivative thereof (also referred to herein as "nucleobase"). A nucleotide" refers to a nucleoside, including a phosphate group. Modified nucleotides may by synthesized by any useful method, such as, for example, chemically, enzymatically, or recombinantly, to include one or more modified or non-natural nucleosides. Polynucleotides may comprise a region or regions of linked nucleosides. Such regions may have variable backbone linkages. The linkages may be standard phosphdioester linkages, in which case the polynucleotides would comprise regions of nucleotides.

Modified nucleotide base pairing encompasses not only the standard adenosine-thymine, adenosine-uracil, or guanosine-cytosine base pairs, but also base pairs formed between nucleotides and/or modified nucleotides comprising non-standard or modified bases, wherein the arrangement of hydrogen bond donors and hydrogen bond acceptors permits hydrogen bonding between a non-standard base and a standard base or between two complementary non-standard base structures. One example of such non-standard base pairing is the base pairing between the modified nucleotide inosine and adenine, cytosine or uracil. Any combination of base/sugar or linker may be incorporated into polynucleotides of the present disclosure.

Modifications of polynucleotides (e.g., RNA polynucleotides, such as mRNA polynucleotides) that are useful in the vaccines of the present disclosure include, but are not limited to the following: 2-methylthio-N6-(cis-hydroxyisopentenyl)adenosine; 2-methylthio-N6-methyladenosine; 2-methylthio-N6-threonyl carbamoyladenosine; N6-glycinylcarbamoyladenosine; N6-isopentenyladenosine; N6-methyladenosine; N6-threonylcarbamoyladenosine; 1,2'-O-dimethyladenosine; 1-methyladenosine; 2'-O-methyladenosine; 2'-O-ribosyladenosine (phosphate); 2-methyladenosine; 2-methylthio-N6 isopentenyladenosine; 2-methylthio-N6-hydroxynorvalyl carbamoyladenosine; 2'-O-methyladenosine; 2'-O-ribosyladenosine (phosphate); Isopentenyladenosine; N6-(cis-hydroxyisopentenyl)adenosine; N6,2'-O-dimethyladenosine; N6,2'-O-dimethyladenosine; N6,N6,2'-O-trimethyladenosine; N6,N6-dimethyladenosine; N6-acetyladenosine; N6-hydroxynorvalylcarbamoyladenosine; N6-methyl-N6-threonylcarbamoyladenosine; 2-methyladenosine; 2-methylthio-N6-isopentenyladenosine; 7-deaza-adenosine; N1-methyl-adenosine; N6,N6 (dimethyl)adenine; N6-cis-hydroxy-isopentenyl-adenosine; α-thio-adenosine; 2 (amino)adenine; 2 (aminopropyl)adenine; 2 (methylthio) N6 (isopentenyl)adenine; 2-(alkyl)adenine; 2-(aminoalkyl)adenine; 2-(aminopropyl)adenine; 2-(halo)adenine; 2-(halo) adenine; 2-(propyl)adenine; 2'-Amino-2'-deoxy-ATP; 2'-Azido-2'-deox-ATP; 2'-Deoxy-2'-a-aminoadenosine TP; 2'-Deoxy-2'-a-azidoadenosine TP; 6 (alkyl)adenine; 6 (methyl)adenine; 6-(alkyl)adenine; 6-(methyl)adenine; 7 (deaza)adenine; 8 (alkenyl)adenine; 8 (alkyl)adenine; 8 (amino)adenine; 8 (thioalkyl)adenine; 8-(alkenyl)adenine; 8-(alkyl)adenine; 8-(alkynyl)adenine; 8-(amino)adenine; 8-(halo)adenine, 8-(hydroxyl)adenine; 8-(thioalkyl)adenine; 8-(thiol)adenine; 8-azido-adenosine; aza adenine; deaza adenine; N6 (methyl)adenine; N6-(isopentyl)adenine; 7-deaza-8-aza-adenosine; 7-methyladenine; 1-Deazaadenosine TP; 2'Fluoro-N6-Bz-deoxyadenosine TP; 2'-OMe-2-Amino-ATP; 2'O-methyl-N6-Bz-deoxyadenosine TP; 2'-a-Ethynyladenosine TP; 2-aminoadenine; 2-Aminoadenosine TP; 2-Amino-ATP; 2'-a-Trifluoromethyladenosine TP; 2-Azidoadenosine TP; 2'-b-Ethynyladenosine TP; 2-Bromoadenosine TP; 2'-b-Trifluoromethyladenosine TP; 2-Chloroadenosine TP; 2'-Deoxy-2',2'-difluoroadenosine TP; 2'-Deoxy-2'-a-mercaptoadenosine TP; 2'-Deoxy-2'-a-thiomethoxyadenosine TP; 2'-Deoxy-2'-b-aminoadenosine TP; 2'-Deoxy-2'-b-azidoadenosine TP; 2'-Deoxy-2'-b-bromoadenosine TP; 2'-Deoxy-2'-b-chloroadenosine TP; 2'-Deoxy-2'-b-fluoroadenosine TP; 2'-Deoxy-2'-b-iodoadenosine TP; 2'-Deoxy-2'-b-mercaptoadenosine TP; 2'-Deoxy-2'-b-thiomethoxyadenosine TP; 2-Fluoroadenosine TP; 2-Iodoadenosine TP; 2-Mercaptoadenosine TP; 2-methoxy-adenine; 2-methylthio-adenine; 2-Trifluoromethyladenosine TP; 3-Deaza-3-bromoadenosine TP; 3-Deaza-3-chloroadenosine TP; 3-Deaza-3-fluoroadenosine TP; 3-Deaza-3-iodoadenosine TP; 3-Deazaadenosine TP; 4'-Azidoadenosine TP; 4'-Carbocyclic adenosine TP; 4'-Ethynyladenosine TP; 5'-Homo-adenosine TP; 8-Aza-ATP; 8-bromo-adenosine TP; 8-Trifluoromethyladenosine TP; 9-Deazaadenosine TP; 2-aminopurine; 7-deaza-2,6-diaminopurine; 7-deaza-8-aza-2,6-diaminopurine; 7-deaza-8-aza-2-aminopurine; 2,6-diaminopurine; 7-deaza-8-aza-adenine, 7-deaza-2-aminopurine; 2-thiocytidine, 3-methylcytidine; 5-formylcytidine; 5-hydroxymethylcytidine; 5-methylcytidine; N4-acetylcytidine; 2'-O-methylcytidine; 2'-O-methylcytidine; 5,2'-O-dimethylcytidine; 5-formyl-2'-O-methylcytidine; Lysidine; N4,2'-O-dimethylcytidine; N4-acetyl-2'-O-methylcytidine; N4-methylcytidine; N4,N4-Dimethyl-2'-OMe-Cytidine TP; 4-methylcytidine; 5-aza-cytidine; Pseudo-iso-cytidine; pyrrolo-cytidine; α-thio-cytidine; 2-(thio)cytosine; 2'-Amino-2-deoxy-CTP; 2'-Azido-2-deoxy-CTP; 2'-Deoxy-2'-a-aminocytidine TP; 2'-Deoxy-2'-a-azidocytidine TP; 3 (deaza) 5 (aza)cytosine; 3 (methyl)cytosine; 3-(alkyl)cytosine, 3-(deaza) 5 (aza)cytosine; 3-(methyl)cytidine; 4,2'-O-dimethylcytidine; 5 (halo)cytosine; 5 (methyl)cytosine; 5 (propynyl)cytosine; 5 (trifluoromethyl)cytosine; 5-(alkyl) cytosine; 5-(alkynyl)cytosine; 5-(halo)cytosine; 5-(propynyl)cytosine; 5-(trifluoromethyl)cytosine; 5-bromo-cytidine; 5-iodo-cytidine; 5-propynyl cytosine; 6-(azo)cytosine; 6-aza-cytidine; aza cytosine; deaza cytosine; N4 (acetyl) cytosine; 1-methyl-1-deaza-pseudoisocytidine; 1-methyl-pseudoisocytidine; 2-methoxy-5-methyl-cytidine; 2-methoxy-cytidine; 2-thio-5-methyl-cytidine; 4-methoxy-1-methyl-pseudoisocytidine; 4-methoxy-pseudoisocytidine; 4-thio-1-methyl-1-deaza-pseudoisocytidine; 4-thio-1-methyl-pseudoisocytidine; 4-thio-pseudoisocytidine; 5-aza-zebularine; 5-methyl-zebularine; pyrrolo-pseudoisocytidine; Zebularine; (E)-5-(2-Bromo-vinyl)cytidine TP; 2,2'-anhydro-cytidine TP hydrochloride; 2'Fluor-N4-Bz-cytidine TP; 2'Fluoro-N4-Acetyl-cytidine TP; 2'-O-Methyl-N4-Acetyl-cytidine TP; 2'O-methyl-N4-Bz-cytidine TP; 2'-a-Ethynylcytidine TP; 2'-a-Trifluoromethylcytidine TP; 2'-b-Ethynylcytidine TP; 2'-b-Trifluoromethylctidine TP; 2'-Deoxy-2',2'-difluorocytidine TP; 2'-Deoxy-2'-a-mercaptocytidine TP; 2'-Deoxy-2'-a-thiomethoxycytidine TP; 2'-Deoxy-2'-b-aminocytidine TP; 2'-Deoxy-2'-b-azidocytidine TP; 2'-Deoxy-2'-b-bromocytidine TP; 2'-Deoxy-2'-b-chlorocytidine TP; 2'-Deoxy-2'-b-fluorocytidine TP; 2'-Deoxy-2'-b-iodocytidine TP; 2'-Deoxy-2'-b-mercaptocytidine TP; 2'-Deoxy-2'-b-thiomethoxycytidine TP; 2'-O-Methyl-5-(1-propynyl)cytidine TP; 3'-Ethynylcytidine TP; 4'-Azido-cytidine TP; 4'-Carbocyclic cytidine TP; 4'-Ethynylcytidine TP; 5-(1-Propynyl)ara-cytidine TP; 5-(2-Chloro-phenyl)-2-thiocytidine TP; 5-(4-Amino-phenyl)-2-thiocytidine TP; 5-Aminoalkyl-CTP; 5-Cyanocytidine TP; 5-Ethynylara-cytidine TP; 5-Ethynylcytidine TP; 5'-Homo-cytidine TP; 5-Methoxycytidine TP; 5-Trifluoromethyl-Cytidine TP; N4-Amino-cytidine TP; N4-Benzoyl-cytidine TP; Pseudoisocytidine; 7-methylguanosine; N2,2'-O-dimethylguanosine; N2-methylguanosine; Wyosine; 1,2'-O-dimethylguanosine; 1-methylguanosine; 2'-O-methylguanosine; 2'-O-ribosylguanosine (phosphate); 2'-O-methylguanosine; 2'-O-ribosylguanosine (phosphate); 7-aminomethyl-7-deazaguanosine; 7-cyano-7-deazaguanosine; Archaeosine; Methylwyosine, N2,7-dimethylguanosine; N2,N2,2'-O-trimethylguanosine; N2,N2,7-trimethylguanosine; N2,N2-dimethylguanosine; N2,7,2'-O-trimethylguanosine; 6-thioguanosine; 7-deaza-guanosine; 8-oxo-guanosine; N1-methyl-guanosine; α-thio-guanosine; 2 (propyl)guanine; 2-(alkyl)guanine; 2'-Amino-2 deoxy-GTP; 2'-Azido-2'-deoxy-GTP; 2'-Deoxy-2'-a-aminoguanosine TP; 2'-Deoxy-2'-a-azidoguanosine TP; 6 (methyl)guanine; 6-(alkyl)guanine; 6-(methyl)guanine; 6-methyl-guanosine; 7 (alkyl)guanine; 7 (deaza)guanine; 7 (methyl)guanine; 7-(alkyl)guanine; 7-(deaza)guanine; 7-(methyl)guanine; 8 (alkyl)guanine; 8 (alkynyl)guanine; 8 (halo)guanine; 8 (thioalkyl)guanine; 8-alkenyl)guanine; 8-(alkyl)guanine; 8-(alkynyl)guanine; 8-(amino)guanine; 8-(halo)guanine; 8-(hydroxyl)guanine; 8-(thioalkyl)guanine; 8-(thiol)guanine; aza guanine; deaza guanine; N (methyl)guanine; N-(methyl)guanine; 1-methyl-6-thio-guanosine; 6-methoxy-guanosine; 6-thio-7-deaza-8-aza-guanosine; 6-thio-7-deaza-guanosine; 6-thio-7-methyl-guanosine; 7-deaza-8-aza-guanosine; 7-methyl-8-oxo-guanosine; N2,N2-dimethyl-6-thio-guanosine; N2-methyl-6-thio-guanosine; 1-Me-GTP; 2'Fluoro-N2-isobutyl-guanosine TP; 2'O-methyl-N2-isobutyl-guanosine TP; 2'-a-Ethynylguanosine TP; 2'-a-Trifluoromethylguanosine TP; 2'-b-Ethynylguanosine TP; 2'-b-Trifluoromethylguanosine TP; 2'-Deoxy-2',2'-difluoroguanosine TP; 2'-Deoxy-2'-a-mercaptoguanosine TP; 2'-Deoxy-2'-a-thiomethoxyguanosine TP; 2'-Deoxy-2'-b-aminoguanosine TP; 2'-Deoxy-2'-b-azidoguanosine TP; 2'-Deoxy-2'-b-bomoguanosine TP; 2'-Deoxy-2'-b-chloroguanosine TP; 2'-Deoxy-2'-b-fluoroguanosine TP; 2'-Deoxy-2'-b-iodoguanosine TP; 2'-Deoxy-2'-b-mercaptoguanosine TP; 2'-Deoxy-2'-b-thiomethoxyguanosine TP; 4'-Azidoguanosine TP; 4'-Carbocyclic guanosine TP; 4'-Ethynylguanosine TP; 5'-Homo-guanosine TP; 8-bromo-guanosine TP; 9-Deazaguanosine TP; N2-isobutyl-guanosine TP; 1-methylinosine; Inosine; 1,2'-O-dimethylinosine; 2'-O-methylinosine; 7-methylinosine; 2'-O-methylinosine; Epoxyqueuosine; galactosyl-queuosine; Mannosylqueuosine; Queuosine; allyamino-thymidine; aza thymidine; deaza thymidine; deoxy-thymidine; 2'-O-methyluridine; 2-thiouridine; 3-methyluridine; 5-carboxymethyl uridine; 5-hydroxyuridine; 5-methyluridine; 5-taurinomethyl-2-thiouridine; 5-taurinomethyluridine; Dihydrouridine; Pseudouridine; (3-(3-amino-3-carboxypropyl)uridine; 1-methyl-3-(3-amino-5-carboxypropyl)pseudouridine; 1-methylpseduouridine; 1-methyl-pseudouridine; 2'-O-methyluridine; 2'-O-methylpseudouridine; 2'-O-methyluridine; 2-thio-2'-O-methyluridine; 3-(3-amino-3-carboxy propyl)uridine; 3,2'-O-dimethyluridine; 3-Methyl-pseudo-Uridine TP; 4-thiouridine; 5-(carboxyhydroxymethyl)uridine; 5-(carboxyhydroxymethyl)uridine methyl ester; 5,2'-O-dimethyluridine; 5,6-dihydro-uridine; 5-aminomethyl-2-thiouridine; 5-carbamoylmethyl-2'-O-methyluridine; 5-carbamoylmethyl uridine; 5-carboxyhydroxymethyluridine; 5-carboxyhydroxymethyluridine methyl ester; 5-carboxymethylaminomethyl-2'-O-methyluridine; 5-carboxymethylaminomethyl-2-thiouridine; 5-carboxymethylaminomethyl-2-thiouridine; 5-carboxymethylaminomethyluridine; 5-carboxymethylaminomethyluridine; 5-Carbamoylmethyluridine TP; 5-methoxycarbonylmethyl-2'-O-methyluridine; 5-methoxycarbonylmethyl-2-thiouridine; 5-methoxycarbonylmethyluridine; 5-methoxyuridine; 5-methyl-2-thiouridine; 5-methylaminomethyl-2-selenouridine; 5-methylaminomethyl-2-thiouridine; 5-methylaminomethyl uridine; 5-Methyldihydrouridine; 5-Oxyacetic acid-Uridine TP; 5-Oxyacetic acid-methyl ester-Uridine TP; N1-methyl-pseudo-uridine; uridine 5-oxyacetic acid; uridine 5-oxyacetic acid methyl ester; 3-(3-Amino-3-carboxypropyl)-Uridine TP; 5-(iso-Pentenylaminomethyl)-2-thiouridine TP; 5-(iso-Pentenylaminomethyl)-2'-O-methyluridine TP; 5-(iso-Pentenylaminomethyl)uridine TP; 5-propynyl uracil; α-thio-uridine; 1 (aminoalkylamino-carbonylethylenyl)-2 (thio)-pseudouracil; 1 (aminoalkylaminocarbonylethylenyl)-2,4-(dithio)pseudouracil; 1 (aminoalkylaminocarbonylethylenyl)-4 (thio)pseudouracil; 1 (aminoalkylaminocarbonylethylenyl)-pseudouracil; 1 (aminocarbonylethylenyl)-2(thio)-pseudouracil; 1 (aminocarbonylethylenyl)-2,4-(dithio)pseudouracil; 1 (aminocarbonylethylenyl)-4 (thio)pseudouracil; 1 (aminocarbonylethylenyl)-pseudouracil; 1 substituted 2(thio)-pseudouracil; 1 substituted 2,4-(dithio)pseudouracil; 1 substituted 4 (thio) pseudouracil; 1 substituted pseudouracil; 1-(aminoalkylamino-carbonylethylenyl)-2-(thio)-pseudouracil; 1-Methyl-3-(3-amino-3-carboxypropyl) pseudouridine TP; 1-Methyl-3-(3-amino-3-carboxypropyl)pseudo-UTP; 1-Methyl-pseudo-UTP; 2 (thio)pseudouracil; 2' deoxy uridine; 2' fluorouridine; 2-(thio)uracil; 2,4-(dithio)pseudouracil; 2' methyl, 2'amino, 2'azido, 2'fluoro-guanosine; 2'-Amino-2'-deoxy-UTP; 2'-Azido-2'-deoxy-UTP; 2'-Azido-deoxyuridine TP; 2'-O-methylpseudouridine; 2' deoxy uridine; 2' fluorouridine; 2'-Deoxy-2'-a-aminouridine TP; 2'-Deoxy-2'-a-azidouridine TP; 2-methylpseudouridine; 3 (3 amino-3 carboxypropyl)uracil; 4 (thio)pseudouracil; 4-(thio)pseudouracil, 4-(thio)uracil; 4-thiouracil, 5 (1,3-diazole-1-alkyl)uracil; 5 (2-aminopropyl)uracil; 5 (aminoalkyl)uracil; 5 (dimethylaminoalkyl)uracil; 5 (guanidiniumalkyl)uracil; 5 (methoxycarbonylmethyl)-2-(thio)uracil; 5 (methoxycarbonyl-methyl)uracil; 5 (methyl) 2 (thio)uracil; 5 (methyl) 2,4 (dithio)uracil; 5 (methyl) 4 (thio)uracil; 5 (methylaminomethyl)-2 (thio)uracil; 5 (methylaminomethyl)-2,4 (dithio)uracil; 5 (methylaminomethyl)-4 (thio) uracil; 5 (propynyl)uracil; 5 (trifluoromethyl)uracil; 5-(2-aminopropyl)uracil; 5-(alkyl)-2-(thio)pseudouracil; 5-(alkyl)-2,4 (dithio)pseudouracil; 5-(alkyl)-4 (thio) pseudouracil; 5-(alkyl)pseudouracil; 5-(alkyl)uracil; 5-(alkynyl)uracil; 5-(allylamino)uracil; 5-(cyanoalkyl)uracil; 5-(di alkylaminoalkyl)uracil; 5-(dimethylaminoalkyl) uracil; 5-(guanidiniumalkyl)uracil; 5-(halo)uracil; 5-(1,3-diazole-1-alkyl)uracil; 5-(methoxy)uracil; 5-(methoxy carbonylmethyl)-2-(thio)uracil; 5-(methoxycarbonyl-methyl)uracil; 5-(methyl) (thio)uracil; 5-(methyl) 2.4 (dithio)uracil; 5-(methyl) 4 (thio)uracil; 5-(methyl)-2-(thio) pseudouracil; 5-(methyl)-2,4 (dithio)pseudouracil; 5-(methyl)-4 (thio)pseudouracil; 5-(methyl)pseudouracil; 5-(methylaminomethyl)-2 (thio)uracil; 5-(methylaminomethyl)-2,4(dithio)uracil; 5-(methylaminomethyl)-4-(thio)

uracil; 5-(propynyl)uracil, 5-(trifluoromethyl)uracil; 5-aminoallyl-uridine; 5-bromo-uridine; 5-iodo-uridine; 5-uracil; 6 (azo)uracil; 6-(azo)uracil; 6-aza-uridine; ally-amino-uracil; aza uracil; deaza uracil; N3 (methyl)uracil; Pseudo-UTP-1-2-ethanoic acid; Pseudouracil; 4-Thio-pseudo-UTP; 1-carboxymethyl-pseudouridine; 1-methyl-1-deaza-pseudouridine; 1-propynyl-uridine; 1-taurinomethyl-1-methyl-uridine, 1-taurinomethyl-4-thio-uridine; 1-taurinomethyl-pseudouridine; 2-methoxy-4-thio-pseudouridine; 2-thio-1-methyl-1-deaza-pseudouridine; 2-thio-1-methyl-pseudouridine; 2-thio-5-aza-uridine; 2-thio-dihydropseudouridine; 2-thio-dihydrouridine; 2-thio-pseudouridine; 4-methoxy-2-thio-pseudouridine; 4-methoxy-pseudouridine; 4-thio-1-methyl-pseudouridine; 4-thio-pseudouridine; 5-aza-uridine; Dihydropseudouridine; (±)1-(2-Hydroxypropyl)pseudouridine TP; (2R)-1-(2-Hydroxypropyl)pseudouridine TP; (2S)-1-(2-Hydroxypropyl)pseudouridine TP; (E)-5-(2-Bromo-vinyl)ara-uridine TP; (E)-5-(2-Bromo-vinyl)uridine TP; (Z)-5-(2-Bromo-vinyl)ara-uridine TP; (Z)-5-(2-Bromo-vinyl)uridine TP; 1-(2,2,2-trifluoroethyl)-pseudo-UTP; 1-(2,2,3,3,3-Pentafluoropropyl)pseudouridine TP; 1-(2,2-Diethoxyethyl)pseudouridine TP; 1-(2,4,6-Trimethylbenzyl)pseudouridine TP; 1-(2,4,6-Trimethyl-benzyl)pseudo-UTP; 1-(2,4,6-Trimethyl-phenyl)pseudo-UTP; 1-(2-Amino-2-carboxyethyl)pseudo-UTP; 1-(2-Amino-ethyl)pseudo-UTP; 1-(2-Hydroxyethyl)pseudouridine TP; 1-(2-Methoxyethyl)pseudouridine TP; 1-(3,4-Bis-trifluoromethoxybenzyl)pseudouridine TP; 1-(3,4-Dimethoxybenzyl)pseudouridine TP; 1-(3-Amino-3-carboxypropyl)pseudo-UTP; 1-(3-Amino-propyl)pseudo-UTP; 1-(3-Cyclopropyl-prop-2-ynyl)pseudouridine TP; 1-(4-Amino-4-carboxybutyl)pseudo-UTP; 1-(4-Amino-benzyl)pseudo-UTP; 1-(4-Amino-butyl)pseudo-UTP; 1-(4-Aminophenyl)pseudo-UTP; 1-(4-Azidobenzyl)pseudouridine TP; 1-(4-Bromobenzyl)pseudouridine TP; 1-(4-Chlorobenzyl)pseudouridine TP; 1-(4-Fluorobenzyl)pseudouridine TP; 1-(4-Iodobenzyl)pseudouridine TP; 1-(4-Methanesulfonyl-benzyl)pseudouridine TP; 1-(4-Methoxybenzyl)pseudouridine TP; 1-(4-Methoxy-benzyl)pseudo-UTP; 1-(4-Methoxyphenyl)pseudo-UTP; 1-(4-Methylbenzyl)pseudouridine TP; 1-(4-Methyl-benzyl)pseudo-UTP; 1-(4-Nitrobenzyl)pseudouridine TP; 1-(4-Nitro-benzyl)pseudo-UTP; 1(4-Nitro-phenyl)pseudo-UTP; 1-(4-Thiomethoxybenzyl)pseudouridine TP; 1-(4-Trifluoromethoxybenzyl)pseudouridine TP; 1-(4-Trifluoromethylbenzyl)pseudouridine TP; 1-(5-Amino-pentyl)pseudo-UTP; 1-(6-Amino-hexyl)pseudo-UTP; 1,6-Dimethyl-pseudo-UTP; 1-[3-(2-{2-[2-(2-Aminoethoxy)-ethoxy]-ethoxy}-ethoxy)-propionyl]pseudouridine TP; 1-{3-[2-(2-Aminoethoxy)-ethoxy]-propionyl} pseudouridine TP; 1-Acetylpseudouridine TP; 1-Alkyl-6-(1-propynyl)-pseudo-UTP; 1-Alkyl-6-(2-propynyl)-pseudo-UTP; 1-Alkyl-6-allyl-pseudo-UTP; 1-Alkyl-6-ethynyl-pseudo-UTP; 1-Alkyl-6-homoallyl-pseudo-UTP; 1-Alkyl-6-vinyl-pseudo-UTP; 1-Allylpseudouridine TP; 1-Aminomethyl-pseudo-UTP; 1-Benzoylpseudouridine TP; 1-Benzyloxymethylpseudouridine TP; 1-Benzyl-pseudo-UTP; 1-Biotinyl-PEG2-pseudouridine TP; 1-Biotinylpseudouridine TP; 1-Butyl-pseudo-UTP; 1-Cyanomethylpseudouridine TP; 1-Cyclobutylmethyl-pseudo-UTP; 1-Cyclobutyl-pseudo-UTP; 1-Cycloheptylmethyl-pseudo-UTP; 1-Cycloheptyl-pseudo-UTP; 1-Cyclohexylmethyl-pseudo-UTP; 1-Cyclohexyl-pseudo-UTP; 1-Cyclooctylmethyl-pseudo-UTP; 1-Cyclooctyl-pseudo-UTP; 1-Cyclopentylmethyl-pseudo-UTP; 1-Cyclopentyl-pseudo-UTP; 1-Cyclopropylmethyl-pseudo-UTP; 1-Cyclopropyl-pseudo-UTP; 1-Ethyl-pseudo-UTP; 1-Hexyl-pseudo-UTP; 1-Homoallylpseudouridine TP; 1-Hydroxymethylpseudouridine TP; 1-iso-propyl-pseudo-UTP; 1-Me-2-thio-pseudo-UTP; 1-Me-4-thio-pseudo-UTP; 1-Me-alpha-thio-pseudo-UTP; 1-Methanesulfonylmethylpseudouridine TP; 1-Methoxymethylpseudouridine TP; 1-Methyl-6-(2,2,2-Trifluoroethyl)pseudo-UTP; 1-Methyl-6-(4-morpholino)-pseudo-UTP; 1-Methyl-6-(4-thiomorpholino)-pseudo-UTP; 1-Methyl-6-(substituted phenyl)pseudo-UTP; 1-Methyl-6-amino-pseudo-UTP; 1-Methyl-6-azido-pseudo-UTP; 1-Methyl-6-bromo-pseudo-UTP; 1-Methyl-6-butyl-pseudo-UTP; 1-Methyl-6-chloro-pseudo-UTP; 1-Methyl-6-cyano-pseudo-UTP; 1-Methyl-6-dimethylamino-pseudo-UTP; 1-Methyl-6-ethoxy-pseudo-UTP; 1-Methyl-6-ethylcarboxylate-pseudo-UTP; 1-Methyl-6-ethyl-pseudo-UTP; 1-Methyl-6-fluoro-pseudo-UTP; 1-Methyl-6-formyl-pseudo-UTP; 1-Methyl-6-hydroxyamino-pseudo-UTP; 1-Methyl-6-hydroxy-pseudo-UTP; 1-Methyl-6-iodo-pseudo-UTP; 1-Methyl-6-iso-propyl-pseudo-UTP; 1-Methyl-6-methoxy-pseudo-UTP; 1-Methyl-6-methylamino-pseudo-UTP; 1-Methyl-6-phenyl-pseudo-UTP; 1-Methyl-6-propyl-pseudo-UTP; 1-Methyl-6-tert-butyl-pseudo-UTP; 1-Methyl-6-trifluoromethoxy-pseudo-UTP; 1-Methyl-6-trifluoromethyl-pseudo-UTP; 1-Morpholinomethylpseudouidine TP; 1-Pentyl-pseudo-UTP; 1-Phenyl-pseudo-UTP; 1-Pivaloylpseudouridine TP; 1-Propargylpseudouridine TP; 1-Propyl-pseudo-UTP; 1-propynyl-pseudouridine; 1-p-tolyl-pseudo-UTP; 1-tert-Butyl-pseudo-UTP; 1-Thiomethoxymethylpseudouridine TP; 1-Thiomorpholinomethylpseudouridine TP; 1-Triluoroacetylpseudouridine TP; 1-Trifluoromethyl-pseudo-UTP; 1-Vinylpseudouridine TP; 2,2'-anhydro-uridine TP; 2'-bromo-deoxyuridine TP; 2'-F-5-Methyl-2'-deoxy-UTP; 2'-OMe-5-Me-UTP; 2'-OMe-pseudo-UTP; 2'-a-Ethynyl uridine TP; 2'-a-Trifluoromethyluridine TP; 2'-b-Ethynyluridine TP; 2'-b-Trifluoromethyluridine TP; 2'-Deoxy-2',2'-difluorouridine TP; 2'-Deoxy-2'-a-mercaptouridine TP; 2'-Deoxy-2'-a-thiomethoxyuridine TP; 2'-Deoxy-2'-b-aminouridine TP; 2'-Deoxy-2'-b-azidouridine TP; 2'-Deoxy-2'-b-bromouridine TP; 2'-Deoxy-2'-b-chlorouridine TP; 2'-Deoxy-2'-b-fluorouridine TP; 2'-Deoxy-2'-b-iodouridine TP; 2'-Deoxy-2'-b-mercaptouridine TP; 2'-Deoxy-2'-b-thiomethoxyuridine TP; 2-methoxy-4-thio-uridine; 2-methoxyuridine; 2'-O-Methyl-5-(1-propynyl)uridine TP; 3-Alkyl-pseudo-UTP; 4'-Azidouridine TP; 4'-Carbocyclic uridine TP; 4'-Ethynyluridine TP; 5-(1-Propynyl)ara-uridine TP; 5-(2-Furanyl)uridine TP; 5-Cyanouridine TP; 5-Dimethylaminouridine TP; 5'-Homo-uridine TP; 5-iodo-2'-fluoro-deoxyuridine TP; 5-Phenylethynyluridine TP; 5-Trideuteromethyl-6-deuterouridine TP; 5-Trifluoromethyl-Uridine TP; 5-Vinylarauridine TP; 6-(2,2,2-Trifluoroethyl)-pseudo-UTP; 6-(4-Morpholino)-pseudo-UTP; 6-(4-Thiomorpholino)-pseudo-UTP; 6-(Substituted-Phenyl)-pseudo-UTP; 6-Amino-pseudo-UTP; 6-Azido-pseudo-UTP; 6-Bromo-pseudo-UTP; 6-Butyl-pseudo-UTP; 6-Chloro-pseudo-UTP; 6-Cyano-pseudo-UTP; 6-Dimethylamino-pseudo-UTP; 6-Ethoxy-pseudo-UTP; 6-Ethylcarboxylate-pseudo-UTP; 6-Ethyl-pseudo-UTP; 6-Fluoro-pseudo-UTP; 6-Formyl-pseudo-UTP; 6-Hydroxyamino-pseudo-UTP; 6-Hydroxy-pseudo-UTP; 6-Iodo-pseudo-UTP; 6-iso-Propyl-pseudo-UTP; 6-Methoxy-pseudo-UTP; 6-Methylamino-pseudo-UTP; 6-Methyl-pseudo-UTP; 6-Phenyl-pseudo-UTP; 6-Phenyl-pseudo-UTP; 6-Propyl-pseudo-UTP; 6-tert-Butyl-pseudo-UTP; 6-Trifluoromethoxy-pseudo-UTP; 6-Trifluoromethyl-pseudo-UTP; Alpha-thio-pseudo-UTP; Pseudouridine (4-methylbenzenesulfonic acid) TP; Pseudouridine 1-(4-methylbenzoic acid) TP; Pseudouridine TP 1-[3-(2-ethoxy)]propionic acid; Pseudouridine TP 1-[3-{2-(2-[2-(2-ethoxy)-ethoxy]-ethoxy)- ethoxy}]propionic acid; Pseudouridine TP 1-[3-{2-(2-[2-{2-(2-ethoxy)-ethoxy)-ethoxy}-ethoxy]-ethoxy)-ethoxy}] propionic acid; Pseudouridine TP 1-[3-{2-(2-[2-ethoxy]-ethoxy)-ethoxy})]propionic acid; Pseudouridine TP 1-[3-{2-(2-ethoxy)-ethoxy}] propionic acid; Pseudouridine TP 1-methylphosphonic acid; Pseudouridine TP 1-methylphosphonic acid diethyl ester; Pseudo-UTP-N1-3-propionic acid; Pseudo-UTP-N1-4-butanoic acid; Pseudo-UTP-N1-5-pentanoic acid; Pseudo-UTP-N1-6-hexanoic acid; Pseudo-UTP-N1-7-heptanoic acid; Pseudo-UTP-N1-methyl-p-benzoic acid; Pseudo-UTP-N1-p-benzoic acid; Wybutosine; Hydroxywybutosine; Isowyosine; Peroxywybutosine; undermodified hydroxywybutosine; 4-demethylwyosine; 2,6-(diamino)purine; 1-(aza)-2-(thio)-3-(aza)-phenoxazin-1-yl; 1,3-(diaza)-2-(oxo)-phenthiazin-1-yl; 1,3-(diaza)-2-(oxo)-phenoxazin-1-yl; 1,3,5-(triaza)-2,6-(dioxa)-naphthalene; 2 (amino)purine; 2,4,5-(trimethyl)phenyl; 2' methyl, 2'amino, 2'azido, 2'fluro-cytidine; 2' methyl, 2'amino, 2'azido, 2'fluro-adenine; 2'methyl, 2'amino, 2'azido, 2'fluro-uridine; 2'-amino-2'-deoxyribose; 2-amino-6-Chloro-purine; 2-aza-inosinyl, 2'-azido-2'-deoxyribose; 2'fluoro-2'-deoxyribose; 2'-fluoro-modified bases; 2'-O-methyl-ribose; 2-oxo-7-aminopyridopyrimidin-3-yl; 2-oxo-pyridopyrimidine-3-yl; 2-pyridinone; 3 nitropyrrole; 3-(methyl)-7-(propynyl) isocarbostyrilyl; 3-(methyl)isocarbostyrilyl; 4-(fluoro)-6-(methyl)benzimidazole; 4-(methyl)benzimidazole; 4-(methyl)indolyl; 4,6-(dimethyl)indolyl; 5 nitroindole; 5 substituted pyrimidines; 5-(methyl)isocarbostyrilyl; 5-nitroindole; 6-(aza)pyrimidine; 6-(azo)thymine; 6-(methyl)-7-(aza)indolyl; 6-chloro-purine; 6-phenyl-pyrrolo-pyrimidin-2-on-3-yl; 7-(aminoalkylhydroxy)-1-(aza)-2-(thio)-3-(aza)-phenthiazin-1-yl; 7-(aminoalkylhydroxy)-1-(aza)-2-(thio)-3-(aza)-phenoxazin-1-yl; 7-(aminoalkylhydroxy)-1,3-(diaza)-2-(oxo)-phenoxazin-1-yl; 7-(aminoalkylhydroxy)-1,3-(diaza)-2-(oxo)-phenthiazin-1-yl; 7-(aminoalkylhydroxy)-1,3-(diaza)-2-(oxo)-phenoxazin-1-yl; 7-(aza)indolyl; 7-(guanidiniumalkylhydroxy)-1-(aza)-2-(thio)-3-(aza)-phenoxazin-1-yl; 7-(guanidiniumalkylhydroxy)-1-(aza)-2-(thio)-3-(aza)-phenthiazin-1-yl; 7-(guanidiniumalkylhydroxy)-1-(aza)-2-(thio)-3-(aza)-phenoxazin-1-yl; 7-(guanidiniumalkylhydroxy)-1,3-(diaza)-2-(oxo)-phenoxazin-1-yl; 7-(guanidiniumalkylhydroxy)-1,3-(diaza)-2-(oxo)-phenthiazin-1-yl; 7-(guanidiniumalkylhydroxy)-1,3-(diaza)-2-(oxo)-phenoxazin-1-yl; 7-(propynyl)isocarbostyrilyl; 7-(propynyl)isocarbostyrilyl, propynyl-7-(aza)indolyl; 7-deaza-inosinyl; 7-substituted 1-(aza)-2-(thio)-3-(aza)-phenoxazin-1-yl; 7-substituted 1,3-(diaza)-2-(oxo)-phenoxazin-1-yl; 9-(methyl)-imidizopyridinyl; Aminoindolyl; Anthracenyl; bis-ortho-(aminoalkylhydroxy)-6-phenyl-pyrrolo-pyrimidin-2-on-3-yl; bis-ortho-substituted-6-phenyl-pyrrolo-pyrimidin-2-on-3-yl; Difluorotolyl; Hypoxanthine; Imidizopyridinyl; Inosinyl; Isocarbostyrilyl; Isoguanisine; N2-substituted purines; N6-methyl-2-amino-purine; N6-substituted purines; N-alkylated derivative; Napthalenyl; Nitrobenzimidazolyl; Nitroimidazolyl; Nitroindazolyl; Nitropyrazolyl; Nubularine; O6-substituted purines; O-alkylated derivative; ortho-(aminoalkylhydroxy)-6-phenyl-pyrrolo-pyrimidin-2-on-3-yl; ortho-substituted-6-phenyl-pyrrolo-pyrimidin-2-on-3-yl; Oxoformycin TP; para-(aminoalkylhydroxy)-6-phenyl-pyrrolo-pyrimidin-2-on-3-yl; para-substituted-6-phenyl-pyrrolo-pyrimidin-2-on-3-yl; Pentacenyl; Phenanthracenyl; Phenyl; propynyl-7-(aza)indolyl; Pyrenyl; pyridopyrimidin-3-yl; pyridopyrimidin-3-yl, 2-oxo-7-aminopyridopyrimidin-3-yl; pyrrolo-pyrimidin-2-on-3-yl; Pyrrolopyrimidinyl; Pyrrolopyrizinyl; Stilbenzyl; substituted 1,2,4-triazoles; Tetracenyl; Tubercidine; Xanthine; Xanthosine-5'-TP; 2-thio-zebularine; 5-aza-2-thio-zebularine; 7-deaza-2-amino-purine; pyridin-4-one ribonucleoside; 2-Amino-riboside-TP; Formycin A TP; Formycin B TP; Pyrrolosine TP; 2'-OH-ara-adenosine TP; 2'-OH-ara-cytidine TP; 2'-OH-ara-uridine TP; 2'-OH-ara-guanosine TP; 5-(2-carbomethoxyvinyl)uridine TP; and N6-(19-Amino-pentaoxanonadecyl)adenosine TP.

In some embodiments, polynucleotides (e.g., RNA polynucleotides, such as mRNA polynucleotides) include a combination of at least two (e.g., 2, 3, 4 or more) of the aforementioned modified nucleobases.

In some embodiments, modified nucleobases in polynucleotides (e.g., RNA polynucleotides, such as mRNA polynucleotides) are selected from the group consisting of pseudouridine ($\psi$), N1-methylpseudouridine ($m^1\psi$), N1-ethylpseudouridine, 2-thiouridine, 4'-thiouridine, 5-methylcytosine, 2-thio-1-methyl-1-deaza-pseudouridine, 2-thio-1-methyl-pseudouridine, 2-thio-5-aza-uridine, 2-thio-dihydropseudouridine, 2-thio-dihydrouridine, 2-thio-pseudouridine, 4-methoxy-2-thio-pseudouridine, 4-methoxy-pseudouridine, 4-thio-1-methyl-pseudouridine, 4-thio-pseudouridine, 5-aza-uridine, dihydropseudouridine, 5-methoxyuridine and 2'-O-methyl uridine. In some embodiments, polynucleotides (e.g., RNA polynucleotides, such as mRNA polynucleotides) include a combination of at least two (e.g., 2, 3, 4 or more) of the aforementioned modified nucleobases.

In some embodiments, modified nucleobases in polynucleotides (e.g., RNA polynucleotides, such as mRNA polynucleotides) are selected from the group consisting of 1-methyl-pseudouridine ($m^1\psi$), 5-methoxy-uridine ($mo^5U$), 5-methyl-cytidine ($m^5C$), pseudouridine ($\psi$), α-thio-guanosine and α-thio-adenosine. In some embodiments, polynucleotides includes a combination of at least two (e.g., 2, 3, 4 or more) of the aforementioned modified nucleobases.

In some embodiments, polynucleotides (e.g., RNA polynucleotides, such as mRNA polynucleotides) comprise pseudouridine ($\psi$) and 5-methyl-cytidine ($m^5C$). In some embodiments, polynucleotides (e.g., RNA polynucleotides, such as mRNA polynucleotides) comprise 1-methyl-pseudouridine ($m^1\psi$). In some embodiments, polynucleotides (e.g., RNA polynucleotides, such as mRNA polynucleotides) comprise 1-methyl-pseudouridine ($m^1\psi$) and 5-methyl-cytidine ($m^5C$). In some embodiments, polynucleotides (e.g., RNA polynucleotides, such as mRNA polynucleotides) comprise 2-thiouridine ($s^2U$). In some embodiments, polynucleotides (e.g., RNA polynucleotides, such as mRNA polynucleotides) comprise 2-thiouridine and 5-methyl-cytidine ($m^5C$). In some embodiments, polynucleotides (e.g., RNA polynucleotides, such as mRNA polynucleotides) comprise methoxy-uridine ($mo^5U$). In some embodiments, polynucleotides (e.g., RNA polynucleotides, such as mRNA polynucleotides) comprise 5-methoxy-uridine ($mo^5U$) and 5-methyl-cytidine ($m^5C$). In some embodiments, polynucleotides (e.g., RNA polynucleotides, such as mRNA polynucleotides) comprise 2'-O-methyl uridine. In some embodiments polynucleotides (e.g., RNA polynucleotides, such as mRNA polynucleotides) comprise 2'-O-methyl uridine and 5-methyl-cytidine ($m^5C$). In some embodiments, polynucleotides (e.g., RNA polynucleotides, such as mRNA polynucleotides) comprise N6-methyl-adenosine ($m^6A$). In some embodiments, polynucleotides (e.g., RNA polynucleotides, such as mRNA polynucleotides) comprise N6-methyl-adenosine ($m^6A$) and 5-methyl-cytidine ($m^5C$).

In some embodiments, polynucleotides (e.g., RNA polynucleotides, such as mRNA polynucleotides) are uniformly modified (e.g., fully modified, modified throughout the entire sequence) for a particular modification. For example, a polynucleotide can be uniformly modified with 5-methyl-cytidine (m$^5$C), meaning that all cytosine residues in the mRNA sequence are replaced with 5-methyl-cytidine (m$^5$C). Similarly, a polynucleotide can be uniformly modified for any type of nucleoside residue present in the sequence by replacement with a modified residue such as those set forth above.

Exemplary nucleobases and nucleosides having a modified cytosine include N4-acetyl-cytidine (ac4C), 5-methyl-cytidine (m5C), 5-halo-cytidine (e.g., 5-iodo-cytidine), 5-hydroxymethyl-cytidine (hm5C), 1-methyl-pseudoisocytidine, 2-thio-cytidine (s2C), and 2-thio-5-methyl-cytidine.

In some embodiments, a modified nucleobase is a modified uridine. Exemplary nucleobases and In some embodiments, a modified nucleobase is a modified cytosine, nucleosides having a modified uridine include 5-cyano uridine, and 4'-thio uridine.

In some embodiments, a modified nucleobase is a modified adenine. Exemplary nucleobases and nucleosides having a modified adenine include 7-deaza-adenine, 1-methyl-adenosine (m1A), 2-methyl-adenine (m2A), and N6-methyl-adenosine (m6A).

In some embodiments, a modified nucleobase is a modified guanine. Exemplary nucleobases and nucleosides having a modified guanine include inosine (I), 1-methyl-inosine (m1I), wyosine (imG), methylwyosine (mimG), 7-deaza-guanosine, 7-cyano-7-deaza-guanosine (preQ0), 7-aminomethyl-7-deaza-guanosine (preQ1), 7-methyl-guanosine (m7G), 1-methyl-guanosine (m1G), 8-oxo-guanosine, 7-methyl-8-oxo-guanosine.

The polynucleotides of the present disclosure may be partially or fully modified along the entire length of the molecule. For example, one or more or all or a given type of nucleotide (e.g., purine or pyrimidine, or any one or more or all of A, G, U, C) may be uniformly modified in a polynucleotide of the disclosure, or in a given predetermined sequence region thereof (e.g., in the mRNA including or excluding the polyA tail). In some embodiments, all nucleotides X in a polynucleotide of the present disclosure (or in a given sequence region thereof) are modified nucleotides, wherein X may any one of nucleotides A, G, U, C, or any one of the combinations A+G, A+U, A+C, G+U, G+C, U+C, A+G+U, A+G+C, G+U+C or A+G+C.

The polynucleotide may contain from about 1% to about 100% modified nucleotides (either in relation to overall nucleotide content, or in relation to one or more types of nucleotide, i.e., any one or more of A, G, U or C) or any intervening percentage (e.g., from 1% to 20%, from 1% to 25%, from 1% to 50%, from 1% to 60%, from 1% to 70%, from 1% to 80%, from 1% to 90%, from 1% to 95%, from 10% to 20%, from 10% to 25%, from 10% to 50%, from 10% to 60%, from 10% to 70%, from 10% to 80%, from 10% to 90%, from 10% to 95%, from 10% to 100%, from 20% to 25%, from 20% to 50%, from 20% to 60%, from 20% to 70%, from 20% to 80%, from 20% to 90%, from 20% to 95%, from 20% to 100%, from 50% to 60%, from 50% to 70%, from 50% to 80%, from 50% to 90%, from 50% to 95%, from 50% to 100%, from 70% to 80%, from 70% to 90%, from 70% to 95%, from 70% to 100%, from 80% to 90%, from 80% to 95%, from 80% to 100%, from 90% to 95%, from 90% to 100%, and from 95% to 100%). Any remaining percentage is accounted for by the presence of unmodified A, G, U, or C.

The polynucleotides may contain at a minimum 1% and at maximum 100% modified nucleotides, or any intervening percentage, such as at least 5% modified nucleotides, at least 10% modified nucleotides, at least 25% modified nucleotides, at least 50% modified nucleotides, at least 80% modified nucleotides, or at least 90% modified nucleotides. For example, the polynucleotides may contain a modified pyrimidine such as a modified uracil or cytosine. In some embodiments, at least 5%, at least 10%, at least 25%, at least 50%, at least 80%, at least 90% or 100% of the uracil in the polynucleotide is replaced with a modified uracil (e.g., a 5-substituted uracil). The modified uracil can be replaced by a compound having a single unique structure, or can be replaced by a plurality of compounds having different structures (e.g., 2, 3, 4 or more unique structures). In some embodiments, at least 5%, at least 10%, at least 25%, at least 50%, at least 80%, at least 90% or 100% of the cytosine in the polynucleotide is replaced with a modified cytosine (e.g., a 5-substituted cytosine). The modified cytosine can be replaced by a compound having a single unique structure, or can be replaced by a plurality of compounds having different structures (e.g., 2, 3, 4 or more unique structures).

Thus, in some embodiments, the RNA (e.g., mRNA) vaccines comprise a 5'UTR element, an optionally codon optimized open reading frame, and a 3'UTR element, a poly(A) sequence and/or a polyadenylation signal wherein the RNA is not chemically modified.

In some embodiments, the modified nucleobase is a modified uracil. Exemplary nucleobases and nucleosides having a modified uracil include pseudouridine (ψ), pyridin-4-one ribonucleoside, 5-aza-uridine, 6-aza-uridine, 2-thio-5-aza-uridine, 2-thio-uridine (s$^2$U), 4-thio-uridine (s$^4$U), 4-thio-pseudouridine, 2-thio-pseudouridine, 5-hydroxy-uridine (ho$^5$U), 5-aminoallyl-uridine, 5-halo-uridine (e.g., 5-iodo-uridine or 5-bromo-uridine), 3-methyl-uridine (m$^3$U), 5-methoxy-uridine (mo$^5$U), uridine 5-oxyacetic acid (cmo$^5$U), uridine 5-oxyacetic acid methyl ester (mcmo$^5$U), 5-carboxymethyl-uridine (cm$^5$U), 1-carboxymethyl-pseudouridine, 5-carboxyhydroxymethyl-uridine (chm$^5$U), 5-carboxyhydroxymethyl-uridine methyl ester (mchm$^5$U), 5-methoxycarbonylmethyl-uridine (mcm$^5$U), 5-methoxycarbonylmethyl-2-thio-uridine (mcm$^5$s$^2$U), 5-aminomethyl-2-thio-uridine (nm$^5$s$^2$U), 5-methylaminomethyl-uridine (mnm$^5$U), 5-methylaminomethyl-2-thio-uridine (mnm$^5$s$^2$U), 5-methylaminomethyl-2-seleno-uridine (mnm$^5$se$^2$U), 5-carbamoylmethyl-uridine (ncm$^5$U), 5-carboxymethylaminomethyl-uridine (cmnm$^5$U), 5-carboxymethylaminomethyl-2-thio-uridine (cmnm$^5$s$^2$U), 5-propynyl-uridine, 1-propynyl-pseudouridine, 5-taurinomethyl-uridine (τm$^5$U), 1-taurinomethyl-pseudouridine, 5-taurinomethyl-2-thio-uridine (τm$^5$s$^2$U), 1-taurinomethyl-4-thio-pseudouridine, 5-methyl-uridine (m$^5$U, i.e., having the nucleobase deoxythymine), 1-methyl-pseudouridine (m$^1$ψ), 5-methyl-2-thio-uridine (m$^5$s$^2$U), 1-methyl-4-thio-pseudouridine (m$^1$s$^4$ψ), 4-thio-1-methyl-pseudouridine, 3-methyl-pseudouridine (m$^3$ψ), 2-thio-1-methyl-pseudouridine, 1-methyl-1-deaza-pseudouridine, 2-thio-1-methyl-1-deaza-pseudouridine, dihydrouridine (D), dihydropseudouridine, 5,6-dihydrouridine, 5-methyl-dihydrouridine (m$^5$D), 2-thio-dihydrouridine, 2-thio-dihydropseudouridine, 2-methoxy-uridine, 2-methoxy-4-thio-uridine, 4-methoxy-pseudouridine, 4-methoxy-2-thio-pseudouridine, N1-methyl-pseudouridine, 3-(3-amino-3-carboxypropyl)uridine (acp$^3$U), 1-methyl-3-(3-amino-3-carboxypropyl)pseudouridine (acp$^3$ψ), 5-(isopentenylaminomethyl)uridine (inm$^5$U), 5-(isopentenylaminomethyl)-2-thio-uridine (inm$^5$s$^2$U), α-thio-uridine, 2'-O-methyl-uridine (Um), 5,2'-O-dimethyl-uridine (m$^5$Um), 2'-O-methyl-pseudouridine (ψm), 2-thio-2'-O-methyl-uridine (s$^2$Um), 5-methoxycarbonylmethyl-2'-

O-methyl-uridine (mcm⁵Um), 5-carbamoylmethyl-2'-O-methyl-uridine (ncm⁵Um), 5-carboxymethylaminomethyl-2'-O-methyl-uridine (cmnm⁵Um), 3,2'-O-dimethyl-uridine (m³Um), and 5-(isopentenylaminomethyl)-2'-O-methyl-uridine (inm⁵Um), 1-thio-uridine, deoxythymidine, 2'-F-ara-uridine, 2'-F-uridine, 2'-OH-ara-uridine, 5-(2-carbomethoxyvinyl) uridine, and 5-[3-(1-E-propenylamino)] uridine.

In some embodiments, the modified nucleobase is a modified cytosine. Exemplary nucleobases and nucleosides having a modified cytosine include 5-aza-cytidine, 6-aza-cytidine, pseudoisocytidine, 3-methyl-cytidine (m³C), N4-acetyl-cytidine (ac⁴C), 5-formylcytidine (f⁵C), N4-methyl-cytidine (m⁴C), 5-methyl-cytidine (m⁵C), 5-halo-cytidine (e.g., 5-iodo-cytidine), 5-hydroxymethyl-cytidine (hm⁵C), 1-methyl-pseudoisocytidine, pyrrolo-cytidine, pyrrolo-pseudoisocytidine, 2-thio-cytidine (s²C), 2-thio-5-methyl-cytidine, 4-thio-pseudoisocytidine, 4-thio-1-methyl-pseudoisocytidine, 4-thio-1-methyl-1-deaza-pseudoisocytidine, 1-methyl-1-deaza-pseudoisocytidine, zebularine, 5-aza-zebularine, 5-methyl-zebularine, 5-aza-2-thio-zebularine, 2-thio-zebularine, 2-methoxy-cytidine, 2-methoxy-5-methyl-cytidine, 4-methoxy-pseudoisocytidine, 4-methoxy-1-methyl-pseudoisocytidine, lysidine (k₂C), α-thio-cytidine, 2'-O-methyl-cytidine (Cm), 5,2'-O-dimethylcytidine (m⁵Cm). N4-acetyl-2'-O-methyl-cytidine (ac⁴Cm), N4,2'-O-dimethylcytidine (m⁴Cm), 5-formyl-2'-O-methyl-cytidine (f₅Cm), N4,N4,2'-O-trimethyl-cytidine (m⁴₂Cm), 1-thio-cytidine, 2'-F-ara-cytidine, 2'-F-cytidine, and 2'-OH-ara-cytidine.

In some embodiments, the modified nucleobase is a modified adenine. Exemplary nucleobases and nucleosides having a modified adenine include 2-amino-purine, 2, 6-diaminopurine, 2-amino-6-halo-purine (e.g., 2-amino-6-chloro-purine), 6-halo-purine (e.g., 6-chloro-purine), 2-amino-6-methyl-purine, 8-azido-adenosine, 7-deaza-adenine, 7-deaza-8-aza-adenine, 7-deaza-2-amino-purine, 7-deaza-8-aza-2-amino-purine, 7-deaza-2,6-diaminopurine, 7-deaza-8-aza-2,6-diaminopurine, 1-methyl-adenosine (m¹A), 2-methyl-adenine (m²A), N6-methyl-adenosine (m⁶A), 2-methylthio-N6-methyl-adenosine (ms²m⁶A). N6-isopentenyl-adenosine (i⁶A), 2-methylthio-N6-isopentenyl-adenosine (ms²i⁶A), N6-(cis-hydroxyisopentenyl)adenosine (io⁶A), 2-methylthio-N6-(cis-hydroxyisopentenyl) adenosine (ms²io⁶A), N6-glycinylcarbamoyl-adenosine (g⁶A), N6-threonylcarbamoyl-adenosine (t⁶A), N6-methyl-N6-threonylcarbamoyl-adenosine (m⁶t⁶A), 2-methylthio-N6-threonylcarbamoyl-adenosine (ms²g⁶A), N6,N6-dimethyl-adenosine (m2A), N6-hydroxynorvalylcarbamoyl-adenosine (hn⁶A), 2-methylthio-N6-hydroxynorvalylcarbamoyl-adenosine (ms²hn⁶A), N6-acetyl-adenosine (ac⁶A), 7-methyl-adenine, 2-methylthio-adenine, 2-methoxy-adenine, α-thio-adenosine, 2'-O-methyl-adenosine (Am), N6,2'-O-dimethyl-adenosine (m⁶Am), N6,N6,2'-O-trimethyl-adenosine (m⁶₂Am), 1,2'-O-dimethyl-adenosine (m¹Am), 2'-O-ribosyladenosine (phosphate) (Ar(p)), 2-amino-N6-methyl-purine, 1-thio-adenosine, 8-azido-adenosine, 2'-F-ara-adenosine, 2'-F-adenosine, 2'-OH-ara-adenosine, and N6-(19-amino-pentaoxanonadecyl)-adenosine.

In some embodiments, the modified nucleobase is a modified guanine. Exemplary nucleobases and nucleosides having a modified guanine include inosine (I), 1-methyl-inosine (m¹I), wyosine (imG), methylwyosine (mimG), 4-demethyl-wyosine (imG-14), isowyosine (imG2), wybutosine (yW), peroxywybutosine (o₂yW), hydroxywybutosine (OhyW), undermodified hydroxybutosine (OhyW*), 7-deaza-guanosine, queuosine (Q), epoxyqueuosine (oQ), galactosyl-queuosine (galQ), mannosyl-queuosine (manQ), 7-cyano-7-deaza-guanosine (preQ₀), 7-aminomethyl-7-deaza-guanosine (preQ₁), archaeosine (G⁺), 7-deaza-8-aza-guanosine, 6-thio-guanosine, 6-thio-7-deaza-guanosine, 6-thio-7-deaza-8-aza-guanosine, 7-methyl-guanosine (m⁷G), 6-thio-7-methyl-guanosine, 7-methyl-inosine, 6-methoxy-guanosine, 1-methyl-guanosine (m¹G), N2-methyl-guanosine (m²G). N2,N2-dimethyl-guanosine (m²₂G), N2,7-dimethyl-guanosine (m²,⁷G), N2,N2,7-dimethyl-guanosine (m²,²,⁷G), 8-oxo-guanosine, 7-methyl-8-oxo-guanosine, 1-methyl-6-thio-guanosine, N2-methyl-6-thio-guanosine. N2,N2-dimethyl-6-thio-guanosine, α-thio-guanosine, 2'-O-methyl-guanosine (Gm), N2-methyl-2'-O-methyl-guanosine (m²Gm), N2,N2-dimethyl-2'-O-methyl-guanosine (m²₂Gm), 1-methyl-2'-O-methyl-guanosine (m¹Gm), N2,7-dimethyl-2'-O-methyl-guanosine (m²,⁷Gm), 2'-O-methyl-inosine (Im), 1,2'-O-dimethyl-inosine (m¹Im), 2'-O-ribosylguanosine (phosphate) (Gr(p)), 1-thio-guanosine, O6-methyl-guanosine, 2'-F-ara-guanosine, and 2'-F-guanosine.

N-Linked Glycosylation Site Mutants

N-linked glycans of viral proteins play important roles in modulating the immune response. Glycans can be important for maintaining the appropriate antigenic conformations, shielding potential neutralization epitopes, and may alter the proteolytic susceptibility of proteins. Some viruses have putative N-linked glycosylation sites. Deletion or modification of an N-linked glycosylation site may enhance the immune response. Thus, the present disclosure provides, in some embodiments. RNA (e.g., mRNA) vaccines comprising nucleic acids (e.g., mRNA) encoding antigenic polypeptides that comprise a deletion or modification at one or more N-linked glycosylation sites.

In Vitro Transcription of RNA (e.g., mRNA)

STD vaccines of the present disclosure comprise at least one RNA polynucleotide, such as a mRNA (e.g., modified mRNA). mRNA, for example, is transcribed in vitro from template DNA, referred to as an "in vitro transcription template." In some embodiments, an in vitro transcription template encodes a 5' untranslated (UTR) region, contains an open reading frame, and encodes a 3' UTR and a polyA tail. The particular nucleic acid sequence composition and length of an in vitro transcription template will depend on the mRNA encoded by the template.

A "5' untranslated region" (5'UTR) refers to a region of an mRNA that is directly upstream (i.e., 5') from the start codon (i.e., the first codon of an mRNA transcript translated by a ribosome) that does not encode a polypeptide.

A "3' untranslated region" (3'UTR) refers to a region of an mRNA that is directly downstream (i.e., 3') from the stop codon (i.e., the codon of an mRNA transcript that signals a termination of translation) that does not encode a polypeptide.

An "open reading frame" is a continuous stretch of DNA beginning with a start codon (e.g., methionine (ATG)), and ending with a stop codon (e.g., TAA, TAG or TGA) and encodes a polypeptide.

A "polyA tail" is a region of mRNA that is downstream, e.g., directly downstream (i.e., 3'), from the 3' UTR that contains multiple, consecutive adenosine monophosphates. A polyA tail may contain 10 to 300 adenosine monophosphates. For example, a polyA tail may contain 10, 20, 30, 40, 50, 60, 70, 80, 90, 100, 110, 120, 130, 140, 150, 160, 170, 180, 190, 200, 210, 220, 230, 240, 250, 260, 270, 280, 290 or 300 adenosine monophosphates. In some embodiments, a polyA tail contains 50 to 250 adenosine monophosphates. In a relevant biological setting (e.g., in cells, in vivo) the poly(A) tail functions to protect mRNA from enzymatic degradation, e.g., in the cytoplasm, and aids in transcription termination, export of the mRNA from the nucleus and translation.

In some embodiments, a polynucleotide includes 200 to 3,000 nucleotides. For example, a polynucleotide may include 200 to 500, 200 to 1000), 200 to 1500, 200 to 3000, 500 to 1000, 500 to 1500, 500 to 2000, 500 to 3000, 1000 to 1500, 1000 to 2000, 1000 to 3000, 1500 to 3000, or 2000 to 3000 nucleotides.

Flagellin Adjuvants

Flagellin is an approximately 500 amino acid monomeric protein that polymerizes to form the flagella associated with bacterial motion. Flagellin is expressed by a variety of flagellated bacteria (*Salmonella typhimurium* for example) as well as non-flagellated bacteria (such as *Escherichia coli*). Sensing of flagellin by cells of the innate immune system (dendritic cells, macrophages, etc.) is mediated by the Toll-like receptor 5 (TLR5) as well as by Nod-like receptors (NLRs) Ipaf and Naip5. TLRs and NLRs have been identified as playing a role in the activation of innate immune response and adaptive immune response. As such, flagellin provides an adjuvant effect in a vaccine.

The nucleotide and amino acid sequences encoding known flagellin polypeptides are publicly available in the NCBI GenBank database. The flagellin sequences from *S. Typhimurium, H. Pylori, V. Cholera, S. marcesens, S. flexneri, T. Pallidum, L, pneumophila, B. burgdorferei, C. difficile, R. melloti, A. tumefiaciens, R. lupini, B. clarridgeiae, P. Mirabilis, B. subtilus, L. monocylogenes, P. aeruginosa*, and *E. coli*, among others are known.

A flagellin polypeptide, as used herein, refers to a full length flagellin protein, immunogenic fragments thereof, and peptides having at least 50% sequence identify to a flagellin protein or immunogenic fragments thereof. Exemplary flagellin proteins include flagellin from *Salmonella typhi* (UniPro Entry number: Q56086), *Salmonella typhimurium* (A0A0C9DG09), *Salmonella enieritidis* (A0A0C9BAB7), and *Salmonella choleraesuis* (Q6V2X8), and −56 (Table 17). In some embodiments, the flagellin polypeptide has at least 60%, 70%, 75%, 80%, 90%, 95%, 97%, 98%, or 99% sequence identify to a flagellin protein or immunogenic fragments thereof.

In some embodiments, the flagellin polypeptide is an immunogenic fragment. An immunogenic fragment is a portion of a flagellin protein that provokes an immune response. In some embodiments, the immune response is a TLR5 immune response. An example of an immunogenic fragment is a flagellin protein in which all or a portion of a hinge region has been deleted or replaced with other amino acids. For example, an antigenic polypeptide may be inserted in the hinge region. Hinge regions are the hypervariable regions of a flagellin. Hinge regions of a flagellin are also referred to as "D3 domain or region, "propeller domain or region," "hypervariable domain or region" and "variable domain or region." "At least a portion of a hinge region," as used herein, refers to any part of the hinge region of the flagellin, or the entirety of the hinge region. In other embodiments an immunogenic fragment of flagellin is a 20, 25, 30, 35, or 40 amino acid C-terminal fragment of flagellin.

The flagellin monomer is formed by domains D0 through D3. D0 and D1, which form the stem, are composed of tandem long alpha helices and are highly conserved among different bacteria. The D1 domain includes several stretches of amino acids that are useful for TLR5 activation. The entire D1 domain or one or more of the active regions within the domain are immunogenic fragments of flagellin. Examples of immunogenic regions within the D1 domain include residues 88-114 and residues 411-431 (in *Salmonella typhimurium* FliC flagellin. Within the 13 amino acids in the 88-100 region, at least 6 substitutions are permitted between *Salmonella* flagellin and other flagellins that still preserve TLR5 activation. Thus, immunogenic fragments of flagellin include flagellin like sequences that activate TLR5 and contain a 13 amino acid motif that is 53% or more identical to the *Salmonella* sequence in 88-100 of FliC (LQRVRELAVQSAN; SEQ ID NO: 462).

In some embodiments, the RNA (e.g., mRNA) vaccine includes an RNA that encodes a fusion protein of flagellin and one or more antigenic polypeptides. A "fusion protein" as used herein, refers to a linking of two components of the construct. In some embodiments, a carboxy-terminus of the antigenic polypeptide is fused or linked to an amino terminus of the flagellin polypeptide. In other embodiments, an amino-terminus of the antigenic polypeptide is fused or linked to a carboxy-terminus of the flagellin polypeptide. The fusion protein may include, for example, one, two, three, four, five, six or more flagellin polypeptides linked to one, two, three, four, five, six or more antigenic polypeptides. When two or more flagellin polypeptides and/or two or more antigenic polypeptides are linked such a construct may be referred to as a "multimer."

Each of the components of a fusion protein may be directly linked to one another or they may be connected through a linker. For instance, the linker may be an amino acid linker. The amino acid linker encoded for by the RNA (e.g., mRNA) vaccine to link the components of the fusion protein may include, for instance, at least one member selected from the group consisting of a lysine residue, a glutamic acid residue, a serine residue and an arginine residue. In some embodiments the linker is 1-30, 1-25, 1-25, 5-10, 5, 15, or 5-20 amino acids in length.

In other embodiments the RNA (e.g., mRNA) vaccine includes at least two separate RNA polynucleotides, one encoding one or more antigenic polypeptides and the other encoding the flagellin polypeptide. The at least two RNA polynucleotides may be co-formulated in a carrier such as a lipid nanoparticle.

Broad Spectrum RNA (e.g., mRNA) Vaccines

There may be situations where persons are at risk for infection with more than one strain of HPV, HSV and/or *Chlamydia*. RNA (e.g., mRNA) therapeutic vaccines are particularly amenable to combination vaccination approaches due to a number of factors including, but not limited to, speed of manufacture, ability to rapidly tailor vaccines to accommodate perceived geographical threat, and the like. Moreover, because the vaccines utilize the human body to produce the antigenic protein, the vaccines are amenable to the production of larger, more complex antigenic proteins, allowing for proper folding, surface expression, antigen presentation, etc, in the human subject. To protect against more than one strain of HPV, HSV and/or *Chlamydia*, a combination vaccine can be administered that includes RNA (e.g., mRNA) encoding at least one antigenic polypeptide protein (or antigenic portion thereof) of a first STD virus and further includes RNA encoding at least one antigenic polypeptide protein (or antigenic portion thereof) of a second STD virus. RNA (e.g., mRNA) can be co-formulated, for example, in a single lipid nanoparticle (LNP) or can be formulated in separate LNPs for co-administration.

Methods of Treatment

Provided herein are compositions (e.g., pharmaceutical compositions), methods, kits and reagents for prevention and/or treatment of STD s in humans and other mammals. STD RNA (e.g. mRNA) vaccines can be used as therapeutic or prophylactic agents, alone or in combination with other vaccine(s). They may be used in medicine to prevent and/or treat STD. In exemplary aspects, the RNA (e.g., mRNA) vaccines of the present disclosure are used to provide prophylactic protection from HPV, HSV and/or *Chlamydia*. Prophylactic protection from HPV, HSV and/or *Chlamydia* can be achieved following administration of a RNA (e.g., mRNA) vaccine of the present disclosure. STD RNA (e.g., mRNA) vaccines of the present disclosure may be used to treat or prevent viral "co-infections" containing two or more STD infections. Vaccines can be administered once, twice, three times, four times or more, but it is likely sufficient to administer the vaccine once (optionally followed by a single booster). It is possible, although less desirable, to administer the vaccine to an infected individual to achieve a therapeutic response. Dosing may need to be adjusted accordingly.

A method of eliciting an immune response in a subject against HPV, HSV and/or *Chlamydia* is provided in aspects of the present disclosure. The method involves administering to the subject a STD RNA (e.g., mRNA) vaccine comprising at least one RNA (e.g., mRNA) polynucleotide having an open reading frame encoding at least one HPV antigenic polypeptide, HSV antigenic polypeptide and/or at least one *Chlamydia* antigenic polypeptide, thereby inducing in the subject an immune response specific to HPV, HSV and/or *Chlamydia* antigenic polypeptide or an immunogenic fragment thereof, wherein anti-antigenic polypeptide antibody titer in the subject is increased following vaccination relative to anti-antigenic polypeptide antibody titer in a subject vaccinated with a prophylactically effective dose of a traditional vaccine against HPV, HSV and/or *Chlamydia*. An "anti-antigenic polypeptide antibody" is a serum antibody the binds specifically to the antigenic polypeptide.

In some embodiments, a RNA (e.g., mRNA) vaccine (e.g., a HPV RNA vaccine, a HSV RNA vaccine, or a *Chlamydia* RNA vaccine) capable of eliciting an immune response is administered intramuscularly or intranasally via a composition including a compound according to Formula (I), (IA), (II), (IIa), (IIb), (IIc), (IId) or (IIe) (e.g., Compound 3, 18, 20, 25, 26, 29, 30, 60, 108-112, or 122).

A prophylactically effective dose is a therapeutically effective dose that prevents infection with the virus at a clinically acceptable level. In some embodiments the therapeutically effective dose is a dose listed in a package insert for the vaccine. A traditional vaccine, as used herein, refers to a vaccine other than the RNA (e.g., mRNA) vaccines of the present disclosure. For instance, a traditional vaccine includes but is not limited to live/attenuated microorganism vaccines, killed/inactivated microorganism vaccines, subunit vaccines, protein antigen vaccines. DNA vaccines, VLP vaccines, etc. In exemplary embodiments, a traditional vaccine is a vaccine that has achieved regulatory approval and/or is registered by a national drug regulatory body, for example the Food and Drug Administration (FDA) in the United States or the European Medicines Agency (EMA).

In some embodiments the anti-antigenic polypeptide antibody titer in the subject is increased 1 log to 10 log following vaccination relative to anti-antigenic polypeptide antibody titer in a subject vaccinated with a prophylactically effective dose of a traditional vaccine against HPV, HSV and/or *Chlamydia*.

In some embodiments the anti-antigenic polypeptide antibody titer in the subject is increased 1 log, 2 log, 3 log, 5 log or 10 log following vaccination relative to anti-antigenic polypeptide antibody titer in a subject vaccinated with a prophylactically effective dose of a traditional vaccine against HPV, HSV and/or *Chlamydia*.

A method of eliciting an immune response in a subject against HPV, HSV and/or *Chlamydia* is provided in other aspects of the disclosure. The method involves administering to the subject a STD RNA (e.g., mRNA) vaccine comprising at least one RNA (e.g., mRNA) polynucleotide having an open reading frame encoding at least one HPV antigenic polypeptide, HSV antigenic polypeptide, and/or *Chlamydia* antigenic polypeptide or an immunogenic fragment thereof, thereby inducing in the subject an immune response specific to HPV antigenic polypeptide. HSV antigenic polypeptide, and/or *Chlamydia* antigenic polypeptide or an immunogenic fragment thereof, wherein the immune response in the subject is equivalent to an immune response in a subject vaccinated with a traditional vaccine against the HPV, HSV and/or *Chlamydia* at 2 times to 100 times the dosage level relative to the RNA (e.g., mRNA) vaccine.

In some embodiments, the immune response in the subject is equivalent to an immune response in a subject vaccinated with a traditional vaccine at 2, 3, 4, 5, 10, 50, 100 times the dosage level relative to the HPV, HSV and/or *Chlamydia* RNA (e.g., mRNA) vaccine. In some embodiments the immune response in the subject is equivalent to an immune response in a subject vaccinated with a traditional vaccine at 10-100 times, or 100-1000 times, the dosage level relative to the HPV, HSV and/or *Chlamydia* RNA (e.g., mRNA) vaccine.

In some embodiments the immune response is assessed by determining [protein] antibody titer in the subject.

Some aspects of the present disclosure provide a method of eliciting an immune response in a subject against a In some embodiments the immune response in the subject is equivalent to an immune response in a subject vaccinated with a traditional vaccine at 2, 3, 4, 5, 10, 50, 100 times the dosage level relative to the HPV, HSV and/or *Chlamydia* RNA (e.g., mRNA) vaccine by administering to the subject a STD RNA (e.g., mRNA) vaccine comprising at least one RNA (e.g., mRNA) polynucleotide having an open reading frame encoding at least one HPV, HSV and/or *Chlamydia* antigenic polypeptide, thereby inducing in the subject an immune response specific to the antigenic polypeptide or an immunogenic fragment thereof, wherein the immune response in the subject is induced 2 days to 10 weeks earlier relative to an immune response induced in a subject vaccinated with a prophylactically effective dose of a traditional vaccine against HPV, HSV and/or *Chlamydia*. In some embodiments, the immune response in the subject is induced in a subject vaccinated with a prophylactically effective dose of a traditional vaccine at 2 times to 100 times the dosage level relative to the RNA (e.g., mRNA) vaccine.

In some embodiments, the immune response in the subject is induced 2 days earlier, or 3 days earlier, relative to an immune response induced in a subject vaccinated with a prophylactically effective dose of a traditional vaccine.

In some embodiments the immune response in the subject is induced 1 week, 2 weeks, 3 weeks, 5 weeks, or 10 weeks earlier relative to an immune response induced in a subject vaccinated with a prophylactically effective dose of a traditional vaccine.

Also provided herein is a method of eliciting an immune response in a subject against HPV, HSV and/or *Chlamydia* by administering to the subject a STD RNA (e.g., mRNA)

vaccine having an open reading frame encoding a first antigenic polypeptide, wherein the RNA polynucleotide does not include a stabilization element, and wherein an adjuvant is not co-formulated or co-administered with the vaccine.

Therapeutic and Prophylactic Compositions

Provided herein are compositions (e.g., pharmaceutical compositions), methods, kits and reagents for prevention, treatment or diagnosis of HPV, HSV and/or *Chlamydia* in humans and other mammals, for example. STD RNA (e.g. mRNA) vaccines can be used as therapeutic or prophylactic agents. They may be used in medicine to prevent and/or treat infectious disease. In some embodiments, the respiratory RNA (e.g., mRNA) vaccines of the present disclosure are used fin the priming of immune effector cells, for example, to activate peripheral blood mononuclear cells (PBMCs) ex vivo, which are then infused (re-infused) into a subject.

In some embodiments, STD vaccine containing RNA (e.g. mRNA) polynucleotides as described herein can be administered to a subject (e.g., a mammalian subject, such as a human subject), and the RNA (e.g., mRNA) polynucleotides are translated in vivo to produce an antigenic polypeptide.

The STD RNA (e.g., mRNA) vaccines may be induced for translation of a polypeptide (e.g., antigen or immunogen) in a cell, tissue or organism. In some embodiments, such translation occurs in vivo, although such translation may occur ex vivo, in culture or in vitro. In some embodiments, the cell, tissue or organism is contacted with an effective amount of a composition containing a STD RNA (e.g., mRNA) vaccine that contains a polynucleotide that has at least one a translatable region encoding an antigenic polypeptide.

An "effective amount" of an STD RNA (e.g. mRNA) vaccine is provided based, at least in part, on the target tissue, target cell type, means of administration, physical characteristics of the polynucleotide (e.g., size, and extent of modified nucleosides) and other components of the vaccine, and other determinants. In general, an effective amount of the STD RNA (e.g., mRNA) vaccine composition provides an induced or boosted immune response as a function of antigen production in the cell, preferably more efficient than a composition containing a corresponding unmodified polynucleotide encoding the same antigen or a peptide antigen. Increased antigen production may be demonstrated by increased cell transfection (the percentage of cells transfected with the RNA. e.g., mRNA, vaccine), increased protein translation from the polynucleotide, decreased nucleic acid degradation (as demonstrated, for example, by increased duration of protein translation from a modified polynucleotide), or altered antigen specific immune response of the host cell.

In some embodiments, RNA (e.g. mRNA) vaccines (including polynucleotides their encoded polypeptides) in accordance with the present disclosure may be used for treatment of HPV, HSV and/or *Chlamydia*.

Respiratory RNA (e.g. mRNA) vaccines may be administered prophylactically or therapeutically as part of an active immunization scheme to healthy individuals or early in infection during the incubation phase or during active infection after onset of symptoms. In some embodiments, the amount of RNA (e.g., mRNA) vaccine of the present disclosure provided to a cell, a tissue or a subject may be an amount effective for immune prophylaxis.

STD RNA (e.g. mRNA) vaccines may be administrated with other prophylactic or therapeutic compounds. As a non-limiting example, a prophylactic or therapeutic compound may be an adjuvant or a booster. As used herein, when referring to a prophylactic composition, such as a vaccine, the term "booster" refers to an extra administration of the prophylactic (vaccine) composition. A booster (or booster vaccine) may be given after an earlier administration of the prophylactic composition. The time of administration between the initial administration of the prophylactic composition and the booster may be, but is not limited to, 1 minute, 2 minutes, 3 minutes, 4 minutes, 5 minutes, 6 minutes, 7 minutes, 8 minutes, 9 minutes, 10 minutes, 15 minutes, 20 minutes 35 minutes, 40 minutes, 45 minutes, 50 minutes, 55 minutes, 1 hour, 2 hours, 3 hours, 4 hours, 5 hours, 6 hours, 7 hours, 8 hours, 9 hours, 10 hours, 11 hours, 12 hours, 13 hours, 14 hours, 15 hours, 16 hours, 17 hours, 18 hours, 19 hours, 20 hours, 21 hours, 22 hours, 23 hours, 1 day, 36 hours, 2 days, 3 days, 4 days, 5 days, 6 days, 1 week, 10 days, 2 weeks, 3 weeks, 1 month, 2 months, 3 months, 4 months, 5 months, 6 months, 7 months, 8 months, 9 months, 10 months, 11 months, 1 year, 18 months, 2 years, 3 years, 4 years, 5 years, 6 years, 7 years, 8 years, 9 years, 10 years, 11 years, 12 years, 13 years, 14 years, 15 years, 16 years, 17 years, 18 years, 19 years, 20 years, 25 years, 30 years, 35 years, 40 years, 45 years, 50 years, 55 years, 60 years, 65 years, 70 years, 75 years, 80 years, 85 years, 90 years, 95 years or more than 99 years. In some embodiments, the time of administration between the initial administration of the prophylactic composition and the booster may be, but is not limited to, 1 week, 2 weeks, 3 weeks, 1 month, 2 months, 3 months, 6 months or 1 year.

In some embodiments, STD RNA (e.g. mRNA) vaccines may be administered intramuscularly, intradermally, or intranasally, similarly to the administration of inactivated vaccines known in the art.

STD RNA (e.g. mRNA) vaccines may be utilized in various settings depending on the prevalence of the infection or the degree or level of unmet medical need. As a non-limiting example, the RNA (e.g., mRNA) vaccines may be utilized to treat and/or prevent a variety of STDs. RNA (e.g., mRNA) vaccines have superior properties in that they produce much larger antibody titers and produce responses early than commercially available anti-viral agents/compositions.

Provided herein are pharmaceutical compositions including STD RNA (e.g. mRNA) vaccines and RNA (e.g. mRNA) vaccine compositions and/or complexes optionally in combination with one or more pharmaceutically acceptable excipients.

HPV, HSV and/or *Chlamydia* RNA (e.g. mRNA) vaccines may be formulated or administered alone or in conjunction with one or more other components. For instance, HPV. HSV and/or *Chlamydia* RNA (e.g., mRNA) vaccines (vaccine compositions) may comprise other components including, but not limited to, adjuvants.

In some embodiments, STD (e.g. mRNA) vaccines do not include an adjuvant (they are adjuvant free).

STD RNA (e.g. mRNA) vaccines may be formulated or administered in combination with one or more pharmaceutically-acceptable excipients. In some embodiments, vaccine compositions comprise at least one additional active substances, such as, for example, a therapeutically-active substance, a prophylactically-active substance, or a combination of both. Vaccine compositions may be sterile, pyrogen-free or both sterile and pyrogen-free. General considerations in the formulation and/or manufacture of pharmaceutical agents, such as vaccine compositions, may be found, for example, in Remington: The Science and Practice of Pharmacy 21st ed., Lippincott Williams & Wilkins, 2005 (incorporated herein by reference in its entirety).

In some embodiments, STD RNA (e.g. mRNA) vaccines are administered to humans, human patients or subjects. For the purposes of the present disclosure, the phrase "active ingredient" generally refers to the RNA (e.g., mRNA) vaccines or the polynucleotides contained therein, for example, RNA polynucleotides (e.g., mRNA polynucleotides) encoding antigenic polypeptides.

Formulations of the STD vaccine compositions described herein may be prepared by any method known or hereafter developed in the art of pharmacology. In general, such preparatory methods include the step of bringing the active ingredient (e.g., mRNA polynucleotide) into association with an excipient and/or one or more other accessory ingredients, and then, if necessary and/or desirable, dividing, shaping and/or packaging the product into a desired single- or multi-dose unit.

Relative amounts of the active ingredient, the pharmaceutically acceptable excipient, and/or any additional ingredients in a pharmaceutical composition in accordance with the disclosure will vary, depending upon the identity, size, and/or condition of the subject treated and further depending upon the route by which the composition is to be administered. By way of example, the composition may comprise between 0.1% and 100%, e.g., between 0.5 and 50%, between 1-30%, between 5-80%, at least 80% (w/w) active ingredient.

STD RNA (e.g. mRNA) vaccines can be formulated using one or more excipients to: increase stability; increase cell transfection; permit the sustained or delayed release (e.g., from a depot formulation); alter the biodistribution (e.g., target to specific tissues or cell types); increase the translation of encoded protein in vivo; and/or alter the release profile of encoded protein (antigen) in vivo. In addition to traditional excipients such as any and all solvents, dispersion media, diluents, or other liquid vehicles, dispersion or suspension aids, surface active agents, isotonic agents, thickening or emulsifying agents, preservatives, excipients can include, without limitation, lipidoids, liposomes, lipid nanoparticles, polymers, lipoplexes, core-shell nanoparticles, peptides, proteins, cells transfected with STD RNA (e.g. mRNA) vaccines (e.g., for transplantation into a subject), hyaluronidase, nanoparticle mimics and combinations thereof.

Stabilizing Elements

Naturally-occurring eukaryotic mRNA molecules have been found to contain stabilizing elements, including, but not limited to untranslated regions (UTR) at their 5'-end (5'UTR) and/or at their 3'-end (3'UTR), in addition to other structural features, such as a 5'-cap structure or a 3'-poly(A) tail. Both the 5'UTR and the 3'UTR are typically transcribed from the genomic DNA and are elements of the premature mRNA. Characteristic structural features of mature mRNA, such as the 5'-cap and the 3'-poly(A) tail are usually added to the transcribed (premature) mRNA during mRNA processing. The 3'-poly(A) tail is typically a stretch of adenine nucleotides added to the 3'-end of the transcribed mRNA. It can comprise up to about 400 adenine nucleotides. In some embodiments the length of the 3'-poly(A) tail may be an essential element with respect to the stability of the individual mRNA.

In some embodiments the RNA (e.g., mRNA) vaccine may include one or more stabilizing elements. Stabilizing elements may include for instance a histone stem-loop. A stem-loop binding protein (SLBP), a 32 kDa protein has been identified. It is associated with the histone stem-loop at the 3'-end of the histone messages in both the nucleus and the cytoplasm. Its expression level is regulated by the cell cycle; it is peaks during the S-phase, when histone mRNA levels are also elevated. The protein has been shown to be essential for efficient 3'-end processing of histone pre-mRNA by the U7 snRNP. SLBP continues to be associated with the stem-loop after processing, and then stimulates the translation of mature histone mRNAs into histone proteins in the cytoplasm. The RNA binding domain of SLBP is conserved through metazoa and protozoa, its binding to the histone stem-loop depends on the structure of the loop. The minimum binding site includes at least three nucleotides 5' and two nucleotides 3' relative to the stem-loop.

In some embodiments, the RNA (e.g., mRNA) vaccines include a coding region, at least one histone stem-loop, and optionally, a poly(A) sequence or polyadenylation signal. The poly(A) sequence or polyadenylation signal generally should enhance the expression level of the encoded protein. The encoded protein, in some embodiments, is not a histone protein, a reporter protein (e.g. Luciferase, GFP, EGFP, β-Galactosidase, EGFP), or a marker or selection protein (e.g, alpha-Globin, Galactokinase and Xanthine:guanine phosphoribosyl transferase (GPT)).

In some embodiments, the combination of a poly(A) sequence or polyadenylation signal and at least one histone stem-loop, even though both represent alternative mechanisms in nature, acts synergistically to increase the protein expression beyond the level observed with either of the individual elements. It has been found that the synergistic effect of the combination of poly(A) and at least one histone stem-loop does not depend on the order of the elements or the length of the poly(A) sequence.

In some embodiments, the RNA (e.g., mRNA) vaccine does not comprise a histone downstream element (HDE). "Histone downstream element" (HDE) includes a purine-rich polynucleotide stretch of approximately 15 to 20 nucleotides 3' of naturally occurring stem-loops, representing the binding site for the U7 snRNA, which is involved in processing of histone pre-mRNA into mature histone mRNA. Ideally, the inventive nucleic acid does not include an intron.

In some embodiments, the RNA (e.g., mRNA) vaccine may or may not contain a enhancer and/or promoter sequence, which may be modified or unmodified or which may be activated or inactivated. In some embodiments, the histone stem-loop is generally derived from histone genes, and includes an intramolecular base pairing of two neighbored partially or entirely reverse complementary sequences separated by a spacer, including (e.g., consisting of) a short sequence, which forms the loop of the structure. The unpaired loop region is typically unable to base pair with either of the stem loop elements. It occurs more often in RNA, as is a key component of many RNA secondary structures, but may be present in single-stranded DNA as well. Stability of the stem-loop structure generally depends on the length, number of mismatches or bulges, and base composition of the paired region. In some embodiments, wobble base pairing (non-Watson-Crick base pairing) may result. In some embodiments, the at least one histone stem-loop sequence comprises a length of 15 to 45 nucleotides.

In other embodiments the RNA (e.g., mRNA) vaccine may have one or more AU-rich sequences removed. These sequences, sometimes referred to as AURES are destabilizing sequences found in the 3'UTR. The AURES may be removed from the RNA (e.g., mRNA) vaccines. Alternatively the AURES may remain in the RNA (e.g., mRNA) vaccine.

Nanoparticle Formulations

In some embodiments, STD RNA (e.g. mRNA) vaccines are formulated in a nanoparticle. In some embodiments, STD RNA (e.g. mRNA) vaccines are formulated in a lipid nanoparticle. In some embodiments. STD RNA (e.g. mRNA) vaccines are formulated in a lipid-polycation complex, referred to as a cationic lipid nanoparticle. As a non-limiting example, the polycation may include a cationic peptide or a polypeptide such as, but not limited to, polylysine, polyornithine and/or polyarginine. In some embodiments, STD RNA (e.g., mRNA) vaccines are formulated in a lipid nanoparticle that includes a non-cationic lipid such as, but not limited to, cholesterol or dioleoyl phosphatidylethanolamine (DOPE).

A lipid nanoparticle formulation may be influenced by, but not limited to, the selection of the cationic lipid component, the degree of cationic lipid saturation, the nature of the PEGylation, ratio of all components and biophysical parameters such as size. In one example by Semple et al. (*Nature Biotech.* 2010 28:172-176), the lipid nanoparticle formulation is composed of 57.1% cationic lipid, 7.1% dipalmitoylphosphatidylcholine, 34.3% cholesterol, and 1.4% PEG-c-DMA. As another example, changing the composition of the cationic lipid can more effectively deliver siRNA to various antigen presenting cells (Basha et al. *Mol Ther.* 2011 19:2186-2200).

In some embodiments, lipid nanoparticle formulations may comprise 35 to 45% cationic lipid, 40% to 50% cationic lipid, 50% to 60% cationic lipid and/or 55% to 65% cationic lipid. In some embodiments, the ratio of lipid to RNA (e.g., mRNA) in lipid nanoparticles may be 5:1 to 20:1, 10:1 to 25:1, 15:1 to 30:1 and/or at least 30:1. In some embodiments, the ratio of PEG in the lipid nanoparticle formulations may be increased or decreased and/or the carbon chain length of the PEG lipid may be modified from C14 to C18 to alter the pharmacokinetics and/or biodistribution of the lipid nanoparticle formulations. As a non-limiting example, lipid nanoparticle formulations may contain 0.5% to 3.0%, 1.0% to 3.5%, 1.5% to 4.0%, 2.0% to 4.5%, 2.5% to 5.0% and/or 3.0% to 6.0% of the lipid molar ratio of PEG-c-DOMG (R-3-[(ω-methoxy-poly(ethyleneglycol)2000)carbamoyl)]-1,2-dimyristyloxypropyl-3-amine) (also referred to herein as PEG-DOMG) as compared to the cationic lipid, DSPC and cholesterol. In some embodiments, the PEG-c-DOMG may be replaced with a PEG lipid such as, but not limited to, PEG-DSG (1,2-Distearoyl-sn-glycerol, methoxypolyethylene glycol), PEG-DMG (1,2-Dimyristoyl-sn-glycerol) and/or PEG-DPG (1,2-Dipalmitoyl-sn-glycerol, methoxypolyethylene glycol). The cationic lipid may be selected from any lipid known in the art such as, but not limited to, DLin-MC3-DMA, DLin-DMA, C12-200 and DLin-KC2-DMA.

In some embodiments, an STD RNA (e.g. mRNA) vaccine formulation is a nanoparticle that comprises at least one lipid. The lipid may be selected from, but is not limited to, DLin-DMA, DLin-K-DMA, 98N12-5, C12-200, DLin-MC3-DMA, DLin-KC2-DMA, DODMA, PLGA, PEG, PEG-DMG, PEGylated lipids and amino alcohol lipids. In some embodiments, the lipid may be a cationic lipid such as, but not limited to, DLin-DMA, DLin-D-DMA, DLin-MC3-DMA, DLin-KC2-DMA, DODMA and amino alcohol lipids. The amino alcohol cationic lipid may be the lipids described in and/or made by the methods described in U.S. Patent Publication No. US20130150625, herein incorporated by reference in its entirety. As a non-limiting example, the cationic lipid may be 2-amino-3-[(9Z,12Z)-octadeca-9,12-dien-1-yloxy]-2-{[(9Z,2Z)-octadeca-9,12-dien-1-yloxy]methyl}propan-1-ol (Compound 1 in US20130150625); 2-amino-3-[(9Z)-octadec-9-en-1-yloxy]-2-{[(9Z)-octadec-9-en-1-yloxy]methyl}propan-1-ol (Compound 2 in US20130150625); 2-amino-3-[(9Z,12Z)-octadeca-9,12-dien-1-yloxy]-2-[(octyloxy)methyl]propan-1-ol (Compound 3 in US20130150625); and 2-(dimethylamino)-3-[(9Z,12Z)-octadeca-9,12-dien-1-yloxy]-2-{[(9Z,12Z)-octadeca-9,12-dien-1-yloxy]methyl}propan-1-ol (Compound 4 in US20130150625); or any pharmaceutically acceptable salt or stereoisomer thereof.

Lipid nanoparticle formulations typically comprise a lipid, in particular, an ionizable cationic lipid, for example, 2,2-dilinoleyl-4-dimethylaminoethyl-[1,3]-dioxolane (DLin-KC2-DMA), dilinoleyl-methyl-4-dimethylaminobutyrate (DLin-MC3-DMA), or di((Z)-non-2-en-1-yl) 9-((4-(dimethylamino)butanoyl)oxy)heptadecanedioate (L319), and further comprise a neutral lipid, a sterol and a molecule capable of reducing particle aggregation, for example a PEG or PEG-modified lipid.

In some embodiments, a lipid nanoparticle formulation consists essentially of (i) at least one lipid selected from the group consisting of 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate (L319); (ii) a neutral lipid selected from DSPC, DPPC, POPC, DOPE and SM; (iii) a sterol, e.g., cholesterol; and (iv) a PEG-lipid. e.g., PEG-DMG or PEG-cDMA, in a molar ratio of 20-60% cationic lipid:5-25% neutral lipid:25-55% sterol; 0.5-15% PEG-lipid.

In some embodiments, a lipid nanoparticle formulation includes 25% to 75% on a molar basis of a cationic lipid selected from 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate (L319). e.g., 35 to 65%, 45 to 65%, 60%, 57.5%, 50% or 40% on a molar basis.

In some embodiments, a lipid nanoparticle formulation includes 0.5% to 15% on a molar basis of the neutral lipid, e.g., 3 to 12%, 5 to 10% or 15%, 10%, or 7.5% on a molar basis. Examples of neutral lipids include, without limitation, DSPC, POPC, DPPC, DOPE and SM. In some embodiments, the formulation includes 5% to 50% on a molar basis of the sterol (e.g., 15 to 45%, 20 to 40%, 40%, 38.5%, 35%, or 31% on a molar basis. A non-limiting example of a sterol is cholesterol. In some embodiments, a lipid nanoparticle formulation includes 0.5% to 20% on a molar basis of the PEG or PEG-modified lipid (e.g., 0.5 to 10%, 0.5 to 5%, 1.5%, 0.5%, 1.5%, 3.5%, or 5% on a molar basis. In some embodiments, a PEG or PEG modified lipid comprises a PEG molecule of an average molecular weight of 2,000 Da. In some embodiments, a PEG or PEG modified lipid comprises a PEG molecule of an average molecular weight of less than 2,000, for example around 1,500 Da, around 1,000 Da, or around 500 Da. Non-limiting examples of PEG-modified lipids include PEG-distearoyl glycerol (PEG-DMG) (also referred herein as PEG-C14 or C14-PEG), PEG-cDMA (further discussed in Reyes et al. J. Controlled Release, 107, 276-287 (2005) the contents of which are herein incorporated by reference in their entirety).

In some embodiments, lipid nanoparticle formulations include 25-75% of a cationic lipid selected from 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanol)oxy)heptadecanedioate (L319), 0.5-15% of the neutral lipid, 5-50% of the sterol, and 0.5-20% of the PEG or PEG-modified lipid on a molar basis.

In some embodiments, lipid nanoparticle formulations include 35-65% of a cationic lipid selected from 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate (L319), 3-12% of the neutral lipid, 15-45% of the sterol, and 0.5-10% of the PEG or PEG-modified lipid on a molar basis.

In some embodiments, lipid nanoparticle formulations include 45-65% of a cationic lipid selected from 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate (L319), 5-10% of the neutral lipid, 25-40% of the sterol, and 0.5-10% of the PEG or PEG-modified lipid on a molar basis.

In some embodiments, lipid nanoparticle formulations include 60% of a cationic lipid selected from 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate (L319), 7.5% of the neutral lipid, 31% of the sterol, and 1.5% of the PEG or PEG-modified lipid on a molar basis.

In some embodiments, lipid nanoparticle formulations include 50% of a cationic lipid selected from 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate (L319), 10% of the neutral lipid, 38.5% of the sterol, and 1.5% of the PEG or PEG-modified lipid on a molar basis.

In some embodiments, lipid nanoparticle formulations include 50% of a cationic lipid selected from 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate (L319), 10% of the neutral lipid, 35% of the sterol, 4.5% or 5% of the PEG or PEG-modified lipid, and 0.5% of the targeting lipid on a molar basis.

In some embodiments, lipid nanoparticle formulations include 40% of a cationic lipid selected from 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate (L319), 15% of the neutral lipid, 40% of the sterol, and 5% of the PEG or PEG-modified lipid on a molar basis.

In some embodiments, lipid nanoparticle formulations include 57.2% of a cationic lipid selected from 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate (L319), 7.1% of the neutral lipid, 34.3% of the sterol, and 1.4% of the PEG or PEG-modified lipid on a molar basis.

In some embodiments, lipid nanoparticle formulations include 57.5% of a cationic lipid selected from the PEG lipid is PEG-cDMA (PEG-cDMA is further discussed in Reyes et al. (J. Controlled Release, 107, 276-287 (2005), the contents of which are herein incorporated by reference in their entirety), 7.5% of the neutral lipid, 31.5% of the sterol, and 3.5% of the PEG or PEG-modified lipid on a molar basis.

In some embodiments, lipid nanoparticle formulations consists essentially of a lipid mixture in molar ratios of 20-70% cationic lipid:5-45% neutral lipid:20-55% cholesterol:0.5-15% PEG-modified lipid. In some embodiments, lipid nanoparticle formulations consists essentially of a lipid mixture in a molar ratio of 20-60% cationic lipid:5-25% neutral lipid:25-55% cholesterol:0.5-15% PEG-modified lipid.

In some embodiments, the molar lipid ratio is 50/10/38.5/1.5 (mol % cationic lipid/neutral lipid, e.g., DSPC/Chol/PEG-modified lipid, e.g., PEG-DMG, PEG-DSG or PEG-DPG), 57.2/7.1134.3/1.4 (mol % cationic lipid/neutral lipid, e.g., DPPC/Chol/PEG-modified lipid, e.g., PEG-cDMA), 40/15/40/5 (mol % cationic lipid neutral lipid, e.g., DSPC/Chol/PEG-modified lipid, e.g., PEG-DMG), 50/10/35/4.5/0.5 (mol % cationic lipid/neutral lipid, e.g., DSPC/Chol/PEG-modified lipid, e.g., PEG-DSG), 50/10/35/5 (cationic lipid/neutral lipid, e.g., DSPC/Chol/PEG-modified lipid, e.g., PEG-DMG), 40/10/40/10 (mol % cationic lipid/neutral lipid, e.g., DSPC/Chol/PEG-modified lipid, e.g., PEG-DMG or PEG-cDMA), 35/15/40/10 (mol % cationic lipid/neutral lipid, e.g., DSPC/Chol/PEG-modified lipid, e.g., PEG-DMG or PEG-cDMA) or 52/13/30/5 (mol % cationic lipid/neutral lipid, e.g., DSPC/Chol/PEG-modified lipid, e.g., PEG-DMG or PEG-cDMA).

Non-limiting examples of lipid nanoparticle compositions and methods of making them are described, for example, in Semple et al. (2010) *Nat. Biotechnol.* 28:172-176; Jayarama et al. (2012), *Angew. Chem. Int. Ed.* 51: 8529-8533 and Maier et al. (2013) *Molecular Therapy* 21, 1570-1578 (the contents of each of which are incorporated herein by reference in their entirety).

In some embodiments, lipid nanoparticle formulations may comprise a cationic lipid, a PEG lipid and a structural lipid and optionally comprise a non-cationic lipid. As a non-limiting example, a lipid nanoparticle may comprise 40-60% of cationic lipid, 5-15% of a non-cationic lipid, 1-2% of a PEG lipid and 30-50% of a structural lipid. As another non-limiting example, the lipid nanoparticle may comprise 50% cationic lipid, 10% non-cationic lipid, 1.5% PEG lipid and 38.5% structural lipid. As yet another non-limiting example, a lipid nanoparticle may comprise 55% cationic lipid, 10% non-cationic lipid, 2.5% PEG lipid and 32.5% structural lipid. In some embodiments, the cationic lipid may be any cationic lipid described herein such as, but not limited to, DLin-KC2-DMA, DLin-MC3-DMA and L319.

In some embodiments, the lipid nanoparticle formulations described herein may be 4 component lipid nanoparticles. The lipid nanoparticle may comprise a cationic lipid, a non-cationic lipid, a PEG lipid and a structural lipid. As a non-limiting example, the lipid nanoparticle may comprise 40-60% of cationic lipid, 5-15% of a non-cationic lipid, 1-2% of a PEG lipid and 30-50% of a structural lipid. As another non-limiting example, the lipid nanoparticle may comprise 50% cationic lipid, 10% non-cationic lipid, 1.5% PEG lipid and 38.5% structural lipid. As yet another non-limiting example, the lipid nanoparticle may comprise 55% cationic lipid, 10% non-cationic lipid, 2.5% PEG lipid and 32.5% structural lipid. In some embodiments, the cationic lipid may be any cationic lipid described herein such as, but not limited to, DLin-KC2-DMA, DLin-MC3-DMA and L319.

In some embodiments, the lipid nanoparticle formulations described herein may comprise a cationic lipid, a non-cationic lipid, a PEG lipid and a structural lipid. As a non-limiting example, the lipid nanoparticle comprise 50% of the cationic lipid DLin-KC2-DMA, 10% of the non-cationic lipid DSPC, 1.5% of the PEG lipid PEG-DOMG and 38.5% of the structural lipid cholesterol. As a non-limiting example, the lipid nanoparticle comprise 50% of the cationic lipid DLin-MC3-DMA, 10% of the non-cationic lipid DSPC, 1.5% of the PEG lipid PEG-DOMG and 38.5% of the structural lipid cholesterol. As a non-limiting example, the lipid nanoparticle comprise 50% of the cationic lipid DLin-MC3-DMA, 10% of the non-cationic lipid DSPC, 1.5% of the PEG lipid PEG-DMG and 38.5% of the structural lipid cholesterol. As yet another non-limiting example, the lipid nanoparticle comprise 55% of the cationic lipid L319, 10% of the non-cationic lipid DSPC, 2.5% of the PEG lipid PEG-DMG and 32.5% of the structural lipid cholesterol.

Relative amounts of the active ingredient, the pharmaceutically acceptable excipient, and/or any additional ingredients in a vaccine composition may vary, depending upon the identity, size, and/or condition of the subject being treated and further depending upon the route by which the composition is to be administered. For example, the composition may comprise between 0.1% and 99% (w/w) of the active ingredient. By way of example, the composition may comprise between 0.1% and 100%, e.g., between 0.5 and 50%, between 1-30%, between 5-80%, at least 80% (w/w) active ingredient.

In some embodiments, the STD RNA (e.g. mRNA) vaccine composition may comprise the polynucleotide described herein, formulated in a lipid nanoparticle comprising MC3, Cholesterol, DSPC and PEG2000-DMG, the buffer trisodium citrate, sucrose and water for injection. As a non-limiting example, the composition comprises: 2.0 mg/mL of drug substance, 21.8 mg/mL of MC3, 10.1 mg/mL of cholesterol, 5.4 mg/mL of DSPC, 2.7 mg/mL of PEG2000-DMG, 5.16 mg/mL of trisodium citrate, 71 mg/mL of sucrose and 1.0 mL of water for injection.

In some embodiments, a nanoparticle (e.g., a lipid nanoparticle) has a mean diameter of 10-500 nm, 20-400 nm, 30-300 nm, 40-200 nm. In some embodiments, a nanoparticle (e.g., a lipid nanoparticle) has a mean diameter of 50-150 nm, 50-200 nm, 80-100 nm or 80-200 nm.

Liposomes, Lipoplexes, and Lipid Nanoparticles

The RNA (e.g., mRNA) vaccines of the disclosure can be formulated using one or more liposomes, lipoplexes, or lipid nanoparticles. In some embodiments, pharmaceutical compositions of RNA (e.g., mRNA) vaccines include liposomes. Liposomes are artificially-prepared vesicles which may primarily be composed of a lipid bilayer and may be used as a delivery vehicle for the administration of nutrients and pharmaceutical formulations. Liposomes can be of different sizes such as, but not limited to, a multilamellar vesicle (MLV) which may be hundreds of nanometers in diameter and may contain a series of concentric bilayers separated by narrow aqueous compartments, a small unicellular vesicle (SUV) which may be smaller than 50 nm in diameter, and a large unilamellar vesicle (LUV) which may be between 50 and 500 nm in diameter. Liposome design may include, but is not limited to, opsonins or ligands in order to improve the attachment of liposomes to unhealthy tissue or to activate events such as, but not limited to, endocytosis. Liposomes may contain a low or a high pH in order to improve the delivery of the pharmaceutical formulations.

The formation of liposomes may depend on the physicochemical characteristics such as, but not limited to, the pharmaceutical formulation entrapped and the liposomal ingredients, the nature of the medium in which the lipid vesicles are dispersed, the effective concentration of the entrapped substance and its potential toxicity, any additional processes involved during the application and/or delivery of the vesicles, the optimization size, polydispersity and the shelf-life of the vesicles for the intended application, and the batch-to-batch reproducibility and possibility of large-scale production of safe and efficient liposomal products.

In some embodiments, pharmaceutical compositions described herein may include, without limitation, liposomes such as those formed from 1,2-dioleyloxy-N,N-dimethylaminopropane (DODMA) liposomes, DiLa2 liposomes from Marina Biotech (Bothell, Wash.), 1,2-dilinoleyloxy-3-dimethylaminopropane (DLin-DMA), 2,2-dilinoleyl-4-(2-dimethylaminoethyl)-[1,3]-dioxolane (DLin-KC2-DMA), and MC3 (US20100324120; herein incorporated by reference in its entirety) and liposomes which may deliver small molecule drugs such as, but not limited to, DOXIL® from Janssen Biotech, Inc. (Horsham, Pa.).

In some embodiments, pharmaceutical compositions described herein may include, without limitation, liposomes such as those formed from the synthesis of stabilized plasmid-lipid particles (SPLP) or stabilized nucleic acid lipid particle (SNALP) that have been previously described and shown to be suitable for oligonucleotide delivery in vitro and in vivo (see Wheeler et al. Gene Therapy. 1999 6:271-281; Zhang et al. Gene Therapy. 1999 6:1438-1447; Jeffs et al. Pharm Res. 2005 22:362-372; Morrissey et al., Nat Biotechnol. 2005 2:1002-1007; Zimmermann et al., Nature. 2006 441:111-114; Heves et al. J Contr Rel. 2005 107:276-287; Semple et al. Nature Biotech. 2010 28:172-176; Judge et al. J Clin Invest. 2009 119:661-673; deFougerolles Hum Gene Ther. 2008 19:125-132; U.S. Patent Publication No US20130122104; all of which are incorporated herein in their entireties). The original manufacture method by Wheeler et al. was a detergent dialysis method, which was later improved by Jeffs et al, and is referred to as the spontaneous vesicle formation method. The liposome formulations are composed of 3 to 4 lipid components in addition to the polynucleotide. As an example a liposome can contain, but is not limited to, 55% cholesterol, 20% disteroylphosphatidyl choline (DSPC), 10% PEG-S-DSG, and 15% 1,2-dioleyloxy-N,N-dimethylaminopropane (DODMA), as described by Jeffs et al. As another example, certain liposome formulations may contain, but are not limited to, 48% cholesterol, 20% DSPC, 2% PEG-c-DMA, and 30% cationic lipid, where the cationic lipid can be 1,2-distearloxy-N,N-dimethylaminopropane (DSDMA), DODMA, DLin-DMA, or 1,2-dilinolenyloxy-3-dimethylaminopropane (DLenDMA), as described by Heyes et al.

In some embodiments, liposome formulations may comprise from about 25.0% cholesterol to about 40.0% cholesterol, from about 30.0% cholesterol to about 45.0% cholesterol, from about 35.0% cholesterol to about 50.0% cholesterol and/or from about 48.5% cholesterol to about 60% cholesterol. In some embodiments, formulations may comprise a percentage of cholesterol selected from the group consisting of 28.5%, 31.5%, 33.5%, 36.5%, 37.0%, 38.5%, 39.0% and 43.5%. In some embodiments, formulations may comprise from about 5.0% to about 10.0% DSPC and/or from about 7.0% to about 15.0% DSPC.

In some embodiments, the RNA (e.g., mRNA) vaccine pharmaceutical compositions may be formulated in liposomes such as, but not limited to, DiLa2 liposomes (Marina Biotech, Bothell, Wash.), SMARTICLES® (Marina Biotech, Bothell, Wash.), neutral DOPC (1,2-dioleoyl-sn-glycero-3-phosphocholine) based liposomes (e.g., siRNA delivery for ovarian cancer (Landen et al. Cancer Biology &

Therapy 2006 5(12)1708-1713); herein incorporated by reference in its entirety) and hyaluronan-coated liposomes (Quiet Therapeutics. Israel).

In some embodiments, the cationic lipid may be a low molecular weight cationic lipid such as those described in U.S. Patent Application No. 20130090372, the contents of which are herein incorporated by reference in their entirety.

In some embodiments, the RNA (e.g., mRNA) vaccines may be formulated in a lipid vesicle, which may have crosslinks between functionalized lipid bilayers.

In some embodiments, the RNA (e.g., mRNA) vaccines may be formulated in a lipid-polycation complex. The formation of the lipid-polycation complex may be accomplished by methods known in the art and/or as described in U.S. Pub. No. 20120178702, herein incorporated by reference in its entirety. As a non-limiting example, the polycation may include a cationic peptide or a polypeptide such as, but not limited to, polylysine, polyornithine and/or polyarginine. In some embodiments, the RNA (e.g., mRNA) vaccines may be formulated in a lipid-polycation complex, which may further include a non-cationic lipid such as, but not limited to, cholesterol or dioleoyl phosphatidylethanolamine (DOPE).

In some embodiments, the ratio of PEG in the lipid nanoparticle (LNP) formulations may be increased or decreased and/or the carbon chain length of the PEG lipid may be modified from C14 to C18 to alter the pharmacokinetics and/or biodistribution of the LNP formulations. As a non-limiting example, LNP formulations may contain from about 0.5% to about 3.0%, from about 1.0% to about 3.5%, from about 1.5% to about 4.0%, from about 2.0% to about 4.5%, from about 2.5% to about 5.0% and/or from about 3.0% to about 6.0% of the lipid molar ratio of PEG-c-DOMG (R-3-[(ω-methoxy-poly(ethyleneglycol)2000)carbamoyl)]-1,2-dimyristyloxypropyl-3-amine) (also referred to herein as PEG-DOMG) as compared to the cationic lipid, DSPC and cholesterol. In some embodiments, the PEG-c-DOMG may be replaced with a PEG lipid such as, but not limited to, PEG-DSG (1,2-Distearoyl-sn-glycerol, methoxypolyethylene glycol), PEG-DMG (1,2-Dimyristoyl-sn-glycerol) and/or PEG-DPG (1,2-Dipalmitoyl-sn-glycerol, methoxypolyethylene glycol). The cationic lipid may be selected from any lipid known in the art such as, but not limited to, DLin-MC3-DMA, DLin-DMA, C12-200 and DLin-KC2-DMA.

In some embodiments, the RNA (e.g., mRNA) vaccines may be formulated in a lipid nanoparticle.

In some embodiments, the RNA (e.g., mRNA) vaccine formulation comprising the polynucleotide is a nanoparticle which may comprise at least one lipid. The lipid may be selected from, but is not limited to, DLin-DMA, DLin-K-DMA, 98N12-5, C12-200, DLin-MC3-DMA, DLin-KC2-DMA, DODMA, PLGA, PEG, PEG-DMG, PEGylated lipids and amino alcohol lipids. In another aspect, the lipid may be a cationic lipid such as, but not limited to, DLin-DMA, DLin-D-DMA, DLin-MC3-DMA, DLin-KC2-DMA, DODMA and amino alcohol lipids. The amino alcohol cationic lipid may be the lipids described in and/or made by the methods described in U.S. Patent Publication No. US20130150625, herein incorporated by reference in its entirety. As a non-limiting example, the cationic lipid may be 2-amino-3-[(9Z,12Z)-octadeca-9,12-dien-1-yloxy]-2-{[(9Z,2Z)-octadeca-9,12-dien-1-yloxy]methyl}propan-1-ol (Compound 1 in US20130150625); 2-amino-3-[(9Z)-octadec-9-en-1-yloxy]-2-{[(9Z)-octadec-9-en-1-yloxy]methyl}propan-1-ol (Compound 2 in US20130150625), 2-amino-3-[(9Z,12Z)-octadeca-9,12-dien-1-yloxy]-2-[(octyloxy)methyl]propan-1-ol (Compound 3 in US20130150625), and 2-(dimethylamino)-3-[(9Z,12Z)-octadeca-9,12-dien-1-yloxy]-2-{[(9Z,12Z)-octadeca-9,12-dien-1-yloxy]methyl}propan-1-ol (Compound 4 in US20130150625); or any pharmaceutically acceptable salt or stereoisomer thereof.

Lipid nanoparticle formulations typically comprise a lipid, in particular, an ionizable cationic lipid, for example, 2,2-dilinoleyl-4-dimethylaminoethyl-[1,3]-dioxolane (DLin-KC2-DMA), dilinoleyl-methyl-4-dimethylaminobutyrate (DLin-MC3-DMA), or di((Z)-non-2-en-1-yl) 9-((4-(dimethylamino)butanoyl)oxy)heptadecanedioate (L319), and further comprise a neutral lipid, a sterol and a molecule capable of reducing particle aggregation, for example a PEG or PEG-modified lipid.

In some embodiments, the lipid nanoparticle formulation consists essentially of (i) at least one lipid selected from the group consisting of 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate (L319); (ii) a neutral lipid selected from DSPC, DPPC, POPC, DOPE and SM; (iii) a sterol, e.g., cholesterol; and (iv) a PEG-lipid, e.g., PEG-DMG or PEG-cDMA, in a molar ratio of about 20-60% cationic lipid:5-25% neutral lipid:25-55% sterol; 0.5-15% PEG-lipid.

In some embodiments, the formulation includes from about 25% to about 75% on a molar basis of a cationic lipid selected from 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate (L319), e.g., from about 35 to about 65%, from about 45 to about 65%, about 60%, about 57.5%, about 50% or about 40% on a molar basis.

In some embodiments, the formulation includes from about 0.5% to about 15% on a molar basis of the neutral lipid e.g., from about 3 to about 12%, from about 5 to about 10% or about 15%, about 10%, or about 7.5% on a molar basis. Examples of neutral lipids include, but are not limited to, DSPC, POPC, DPPC, DOPE and SM. In some embodiments, the formulation includes from about 5% to about 50% on a molar basis of the sterol (e.g., about 15 to about 45%, about 20 to about 40%, about 40%, about 38.5%, about 35%, or about 31% on a molar basis. An exemplary sterol is cholesterol. In some embodiments, the formulation includes from about 0.5% to about 20% on a molar basis of the PEG or PEG-modified lipid (e.g., about 0.5 to about 10%, about 0.5 to about 5%, about 1.5%, about 0.5%, about 1.5%, about 3.5%, or about 5% on a molar basis. In some embodiments, the PEG or PEG modified lipid comprises a PEG molecule of an average molecular weight of 2,000 Da. In other embodiments, the PEG or PEG modified lipid comprises a PEG molecule of an average molecular weight of less than 2,000, for example around 1,500 Da, around 1,000 Da, or around 500 Da. Examples of PEG-modified lipids include, but are not limited to, PEG-distearoyl glycerol (PEG-DMG) (also referred herein as PEG-C14 or C14-PEG), PEG-cDMA (further discussed in Reyes et al. *J. Controlled Release*, 107, 276-287 (2005) the contents of which are herein incorporated by reference in their entirety)

In some embodiments, the formulations of the present disclosure include 25-75% of a cationic lipid selected from 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate (L319), 0.5-15% of the neutral lipid, 5-50% of the sterol, and 0.5-20% of the PEG or PEG-modified lipid on a molar basis.

In some embodiments, the formulations of the present disclosure include 35-65% of a cationic lipid selected from 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate (L319), 3-12% of the neutral lipid, 15-45% of the sterol, and 0.5-10% of the PEG or PEG-modified lipid on a molar basis.

In some embodiments, the formulations of the present disclosure include 45-65% of a cationic lipid selected from 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate (L319), 5-10% of the neutral lipid, 25-40% of the sterol, and 0.5-10% of the PEG or PEG-modified lipid on a molar basis.

In some embodiments, the formulations of the present disclosure include about 60% of a cationic lipid selected from 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate (L319), about 7.5% of the neutral lipid, about 31% of the sterol, and about 1.5% of the PEG or PEG-modified lipid on a molar basis.

In some embodiments, the formulations of the present disclosure include about 50% of a cationic lipid selected from 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate (L319), about 10% of the neutral lipid, about 38.5% of the sterol, and about 1.5% of the PEG or PEG-modified lipid on a molar basis.

In some embodiments, the formulations of the present disclosure include about 50% of a cationic lipid selected from 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate (L319), about 10% of the neutral lipid, about 35% of the sterol, about 4.5% or about 5% of the PEG or PEG-modified lipid, and about 0.5% of the targeting lipid on a molar basis.

In some embodiments, the formulations of the present disclosure include about 40% of a cationic lipid selected from 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate (L319), about 15% of the neutral lipid, about 40% of the sterol, and about 5% of the PEG or PEG-modified lipid on a molar basis.

In some embodiments, the formulations of the present disclosure include about 57.2% of a cationic lipid selected from 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate (L319), about 7.1% of the neutral lipid, about 34.3% of the sterol, and about 1.4% of the PEG or PEG-modified lipid on a molar basis.

In some embodiments, the formulations of the present disclosure include about 57.5% of a cationic lipid selected from the PEG lipid is PEG-cDMA (PEG-cDMA is further discussed in Reyes et al. (J. Controlled Release, 107, 276-287 (2005), the contents of which are herein incorporated by reference in their entirety), about 7.5% of the neutral lipid, about 31.5% of the sterol, and about 3.5% of the PEG or PEG-modified lipid on a molar basis.

In some embodiments, lipid nanoparticle formulation consists essentially of a lipid mixture in molar ratios of about 20-70% cationic lipid:5-45% neutral lipid:20-55% cholesterol:0.5-15% PEG-modified lipid; more preferably in a molar ratio of about 20-60% cationic lipid:5-25% neutral lipid:25-55% cholesterol:0.5-15% PEG-modified lipid.

In some embodiments, the molar lipid ratio is approximately 50/10/38.5/1.5 (mol % cationic lipid/neutral lipid, e.g., DSPC/Chol/PEG-modified lipid, e.g., PEG-DMG, PEG-DSG or PEG-DPG), 57.2/7.1134.3/1.4 (mol % cationic lipid neutral lipid, e.g., DPPC/Chol/PEG-modified lipid, e.g., PEG-cDMA), 40/15/40/5 (mol % cationic lipid neutral lipid. e.g., DSPC/Chol/PEG-modified lipid, e.g., PEG-DMG), 50/10/35/4.5/0.5 (mol % cationic lipid/neutral lipid, e.g., DSPC/Chol/PEG-modified lipid, e.g., PEG-DSG), 50/10/35/5 (cationic lipid/neutral lipid, e.g., DSPC/Chol/PEG-modified lipid, e.g., PEG-DMG), 40/10/40/10 (mol % cationic lipid/neutral lipid, e.g., DSPC/Chol/PEG-modified lipid, e.g., PEG-DMG or PEG-cDMA), 35/15/40/10 (mol % cationic lipid/neutral lipid, e.g., DSPC/Chol/PEG-modified lipid, e.g., PEG-DMG or PEG-cDMA) or 52/13/30/5 (mol % cationic lipid/neutral lipid, e.g., DSPC/Chol/PEG-modified lipid, e.g., PEG-DMG or PEG-cDMA).

Examples of lipid nanoparticle compositions and methods of making same are described, for example, in Semple et al. (2010) *Nat. Biotechnol.* 28:172-176; Jayarama et al. (2012), *Angew. Chem. Int. Ed.,* 51: 8529-8533; and Maier et al. (2013) *Molecular Therapy* 21, 1570-1578 (the contents of each of which are incorporated herein by reference in their entirety).

In some embodiments, the lipid nanoparticle formulations described herein may comprise a cationic lipid, a PEG lipid and a structural lipid and optionally comprise a non-cationic lipid. As a non-limiting example, the lipid nanoparticle may comprise about 40-60% of cationic lipid, about 5-15% of a non-cationic lipid, about 1-2% of a PEG lipid and about 30-50% of a structural lipid. As another non-limiting example, the lipid nanoparticle may comprise about 50% cationic lipid, about 10% non-cationic lipid, about 1.5% PEG lipid and about 38.5% structural lipid. As yet another non-limiting example, the lipid nanoparticle may comprise about 55% cationic lipid, about 10% non-cationic lipid, about 2.5% PEG lipid and about 32.5% structural lipid. In some embodiments, the cationic lipid may be any cationic lipid described herein such as, but not limited to, DLin-KC2-DMA, DLin-MC3-DMA and L319.

In some embodiments, the lipid nanoparticle formulations described herein may be 4 component lipid nanoparticles. The lipid nanoparticle may comprise a cationic lipid, a non-cationic lipid, a PEG lipid and a structural lipid. As a non-limiting example, the lipid nanoparticle may comprise about 40-60% of cationic lipid, about 5-15% of a non-cationic lipid, about 1-2% of a PEG lipid and about 30-50% of a structural lipid. As another non-limiting example, the lipid nanoparticle may comprise about 50% cationic lipid, about 10% non-cationic lipid, about 1.5% PEG lipid and about 38.5% structural lipid. As yet another non-limiting example, the lipid nanoparticle may comprise about 55% cationic lipid, about 10% non-cationic lipid, about 2.5% PEG lipid and about 32.5% structural lipid. In some embodiments, the cationic lipid may be any cationic lipid described herein such as, but not limited to, DLin-KC2-DMA, DLin-MC3-DMA and L319.

In some embodiments, the lipid nanoparticle formulations described herein may comprise a cationic lipid, a non-cationic lipid, a PEG lipid and a structural lipid. As a non-limiting example, the lipid nanoparticle comprise about 50% of the cationic lipid DLin-KC2-DMA, about 10% of the non-cationic lipid DSPC, about 1.5% of the PEG lipid PEG-DOMG and about 38.5% of the structural lipid cholesterol. As a non-limiting example, the lipid nanoparticle comprise about 50% of the cationic lipid DLin-MC3-DMA, about 10% of the non-cationic lipid DSPC, about 1.5% of the PEG lipid PEG-DOMG and about 38.5% of the structural lipid cholesterol. As a non-limiting example, the lipid nanoparticle comprise about 50% of the cationic lipid DLin-MC3-DMA, about 10% of the non-cationic lipid DSPC, about 1.5% of the PEG lipid PEG-DMG and about 38.5% of the structural lipid cholesterol. As yet another non-limiting example, the lipid nanoparticle comprise about 55% of the cationic lipid L319, about 10% of the non-cationic lipid DSPC, about 2.5% of the PEG lipid PEG-DMG and about 32.5% of the structural lipid cholesterol.

As a non-limiting example, the cationic lipid may be selected from (20Z,23Z)—N,N-dimethylnonacosa-20,23-dien-10-amine, (17Z,20Z)—N,N-dimemylhexacosa-17,20-dien-9-amine, (1Z,19Z)—N5N-dimethylpentacosa-16,19-dien-8-amine, (13Z,16Z)—N,N-dimethyldocosa-13,16-dien-5-amine, (12Z,15Z)—N,N-dimethylhenicosa-12,15-dien-4-amine, (14Z,17Z)—N,N-dimethyltricosa-14,17-dien-6-amine, (15Z,18Z)—N,N-dimethyltetracosa-15,18-dien-7-amine, (18Z,21Z)—N,N-dimethylheptacosa-18,21-dien-10-amine, (15Z,18Z)—N,N-dimethyltetracosa-15,18-dien-5-amine, (14Z,17Z)—N,N-dimethyltricosa-14,17-dien-4-amine, (19Z,22Z)—N,N-dimethyloctacosa-19,22-dien-9-amine, (18Z,21Z)—N,N-dimethylheptacosa-18,21-dien-8-amine, (17Z,20Z)—N,N-dimethylhexacosa-17,20-dien-7-amine, (16Z,19Z)—N,N-dimethylpentacosa-16,19-dien-6-amine, (22Z,25Z)—N,N-dimethylhentriaconta-22,25-dien-10-amine, (21Z,24Z)—N,N-dimethyltriaconta-21,24-dien-9-amine, (18Z)—N,N-dimetylheptacos-18-en-10-amine. (17Z)—N,N-dimethylhexacos-17-en-9-amine, (19Z,22Z)—N,N-dimethyloctacosa-19,22-dien-7-amine, N,N-dimethylheptacosan-10-amine, (20Z,23Z)—N-ethyl-N-methylnonacosa-20,23-dien-10-amine, 1-[(11Z,14Z)-1-nonylicosa-11,14-dien-1-yl]pyrrolidine, (20Z)—N,N-dimethylheptacos-20-en-10-amine, (15Z)—N,N-dimethyl eptacos-15-en-10-amine, (14Z)—N,N-dimethylnonacos-14-en-10-amine, (17Z)—N,N-dimethylnonacos-17-en-10-amine, (24Z)—N,N-dimethyltritriacont-24-en-10-amine, (20Z)—N,N-dimethylnonacos-20-en-10-amine, (22Z)—N,N-dimethylhentriacont-22-en-10-amine, (16Z)—N,N-dimethylpentacos-16-en-8-amine, (12Z,15Z)—N,N-dimethyl-2-nonylhenicosa-12,15-dien-1-amine, (13Z,16Z)—N,N-dimethyl-3-nonyldocosa-13,16-dien-1-amine, N,N-dimethyl-1-[(1S,2R)-2-octylcyclopropyl] eptadecan-8-amine, 1-[(1S,2R)-2-hexylcyclopropyl]-N,N-dimethylnonadecan-10-amine, N,N-dimethyl-1-[(1S,2R)-2-octylcyclopropyl]nonadecan-10-amine, N,N-dimethyl-21-[(1S,2R)-2-octylcyclopropyl]henicosan-10-amine, N,N-dimethyl-1-[(1S,2S)-2-{[(1R,2R)-2-pentylcyclopropyl]methyl}cyclopropyl]nonadecan-10-amine, N,N-di methyl-1-[(1S,2R)-2-octylcyclopropyl]hexadecan-8-amine, N,N-dimethyl-[(1R,2S)-2-undecylcyclopropyl]tetradecan-5-amine, N,N-dimethyl-3-{7-[(1S,2R)-2-octylcyclopropyl]heptyl} dodecan-1-amine, 1-[(1R,2S)-2-heptylcyclopropyl]-N,N-dimethyloctadecan-9-amine, 1-[(1S,2R)-2-decylcyclopropyl]-N,N-dimethylpentadecan-6-amine, N,N-dimethyl-1-[(1S,2R)-2-octylcyclopropyl]pentadecan-8-amine, R—N,N-dimethyl-1-[(9Z,12Z)-octadeca-9,12-dien-1-yloxy]-3-(octyloxy)propan-2-amine, S—N,N-dimethyl-1-[(9Z,12Z)-octadeca-9,12-dien-1-yloxy]-3-(octyloxy)propan-2-amine, 1-{2-[(9Z,12Z)-octadeca-9,12-dien-1-yloxy]-1-[(octyloxy)methyl]ethyl}pyrrolidine, (2S)—N,N-dimethyl-1-[(9Z,12Z)-octadeca-9,12-dien-1-yloxy]-3-[(5Z)-oct-5-en-1-yloxy]propan-2-amine, 1-{2-[(9Z,12Z)-octadeca-9,12-dien-1-yloxy]-1-[(octyloxy)methyl]ethyl}azetidine, (2S)-1-(hexyloxy)-N,N-dimethyl-3-[(9Z,12Z)-octadeca-9,12-dien-1-yloxy]propan-2-amine, (2S)-1-(heptyloxy)-N,N-dimethyl-3-[(9Z,12Z)-octadeca-9,12-dien-1-yloxy]propan-2-amine, N,N-dimethyl-1-(nonyloxy)-3-[(9Z,12Z)-octadeca-9,12-dien-1-yloxy]propan-2-amine. N,N-dimethyl-1-[(9Z)-octadec-9-en-1-yloxy]-3-(octyloxy)propan-2-amine; (2S)—N,N-dimethyl-1-[(6Z,9Z,12Z)-octadeca-6,9,12-trien-1-yloxy]-3-(octyloxy)propan-2-amine, (2S)-1-[(11Z,14Z)-icosa-11,14-dien-1-yloxy]-N,N-dimethyl-3-(pentyloxy)propan-2-amine. (2S)-1-(hexyloxy)-3-[(11Z,14Z)-icosa-11,14-dien-1-yloxy]-N,N-dimethylpropan-2-amine, 1-[(11Z,14Z)-icosa-11,14-dien-1-yloxy]-N,N-dimethyl-3-(octyloxy)propan-2-amine, 1-[(13Z,16Z)-docosa-13,16-dien-1-yloxy]-N,N-dimethyl-3-(octyloxy)propan-2-amine, (2S)-1-[(13Z,16Z)-docosa-13,16-dien-1-yloxy]-3-(hexyloxy)-N,N-dimethylpropan-2-amine, (2S)-1-[(13Z)-docos-13-en-1-yloxy]-3-(hexyloxy)-N,N-dimethylpropan-2-amine, 1-[(13Z)-docos-13-en-1-yloxy]-N,N-dimethyl-3-(octyloxy)propan-2-amine, 1-[(9Z)-hexadec-9-en-1-yloxy]-N,N-dimethyl-3-(octyloxy)propan-2-amine, (2R)—N,N-dimethyl-H(1-metoyloctyl)oxy]-3-[(9Z,12Z)-octadeca-9,12-dien-1-yloxy]propan-2-amine, (2R)-1-[(3,7-dimethyloctyl)oxy]-N,N-dimethyl-3-[(9Z,12Z)-octadeca-9,12-dien-1-yloxy]propan-2-amine, N,N-dimethyl-1-(octyloxy)-3-({8-[(1S,2S)-2-{[(1R,2R)-2-pentylcyclopropyl]methyl}cyclopropyl]octyl}oxy)propan-2-amine, N,N-dimethyl-1-{[8-(2-octylcyclopropyl)octyl]oxy}-3-(octyloxy)propan-2-amine and (11E,20Z,23Z)—N,N-dimethylnonacosa-11,20,2-trien-10-amine or a pharmaceutically acceptable salt or stereoisomer thereof.

In some embodiments, the LNP formulations of the RNA (e.g., mRNA) vaccines may contain PEG-c-DOMG at 3% lipid molar ratio. In some embodiments, the LNP formulations of the RNA (e.g., mRNA) vaccines may contain PEG-c-DOMG at 1.5% lipid molar ratio.

In some embodiments, the pharmaceutical compositions of the RNA (e.g., mRNA) vaccines may include at least one of the PEGylated lipids described in International Publication No. WO2012099755, the contents of which are herein incorporated by reference in their entirety.

In some embodiments, the LNP formulation may contain PEG-DMG 2000 (1,2-dimyristoyl-sn-glycero-3-phosphoethanolamine-N-[methoxy(polyethylene glycol)-2000). In some embodiments, the LNP formulation may contain PEG-DMG 2000, a cationic lipid known in the art and at least one other component. In some embodiments, the LNP formulation may contain PEG-DMG 2000, a cationic lipid known in the art, DSPC and cholesterol. As a non-limiting example, the LNP formulation may contain PEG-DMG 2000, DLin-DMA, DSPC and cholesterol. As another non-limiting example the LNP formulation may contain PEG-DMG 2000, DLin-DMA, DSPC and cholesterol in a molar ratio of 2:40:10:48 (see e.g., Geall et al., Nonviral delivery of self-amplifying RNA (e.g., mRNA) vaccines, PNAS 2012; PMID: 22908294, the contents of each of which are herein incorporated by reference in their entirety).

The lipid nanoparticles described herein may be made in a sterile environment.

In some embodiments, the LNP formulation may be formulated in a nanoparticle such as a nucleic acid-lipid particle. As a non-limiting example, the lipid particle may comprise one or more active agents or therapeutic agents; one or more cationic lipids comprising from about 50 mol % to about 85 mol % of the total lipid present in the particle; one or more non-cationic lipids comprising from about 13 mol % to about 49.5 mol % of the total lipid present in the particle; and one or more conjugated lipids that inhibit aggregation of particles comprising from about 0.5 mol % to about 2 mol % of the total lipid present in the particle.

The nanoparticle formulations may comprise a phosphate conjugate. The phosphate conjugate may increase in vivo circulation times and/or increase the targeted delivery of the nanoparticle. As a non-limiting example, the phosphate conjugates may include a compound of any one of the formulas described in International Application No. WO2013033438, the contents of which are herein incorporated by reference in its entirety.

The nanoparticle formulation may comprise a polymer conjugate. The polymer conjugate may be a water soluble conjugate. The polymer conjugate may have a structure as described in U.S. Patent Application No. 20130059360, the contents of which are herein incorporated by reference in its entirety. In some embodiments, polymer conjugates with the polynucleotides of the present disclosure may be made using the methods and/or segmented polymeric reagents described in U.S. Patent Application No. 20130072709, the contents of which are herein incorporated by reference in its entirety. In some embodiments, the polymer conjugate may have pendant side groups comprising ring moieties such as, but not limited to, the polymer conjugates described in U.S. Patent Publication No. US20130196948, the contents which are herein incorporated by reference in its entirety.

The nanoparticle formulations may comprise a conjugate to enhance the delivery of nanoparticles of the present disclosure in a subject. Further, the conjugate may inhibit phagocytic clearance of the nanoparticles in a subject. In one aspect, the conjugate may be a "self" peptide designed from the human membrane protein CD47 (e.g., the "self" particles described by Rodriguez et al. (*Science* 2013 339, 971-975), herein incorporated by reference in its entirety). As shown by Rodriguez et al., the self peptides delayed macrophage-mediated clearance of nanoparticles which enhanced delivery of the nanoparticles. In another aspect, the conjugate may be the membrane protein CD47 (e.g., see Rodriguez et al. *Science* 2013 339, 971-975, herein incorporated by reference in its entirety). Rodriguez et al. showed that, similarly to "self" peptides, CD47 can increase the circulating particle ratio in a subject as compared to scrambled peptides and PEG coated nanoparticles.

In some embodiments, the RNA (e.g., mRNA) vaccines of the present disclosure are formulated in nanoparticles which comprise a conjugate to enhance the delivery of the nanoparticles of the present disclosure in a subject. The conjugate may be the CD47 membrane or the conjugate may be derived from the CD47 membrane protein, such as the "self" peptide described previously. In some embodiments, the nanoparticle may comprise PEG and a conjugate of CD47 or a derivative thereof. In some embodiments, the nanoparticle may comprise both the "self" peptide described above and the membrane protein CD47.

In some embodiments, a "self" peptide and/or CD47 protein may be conjugated to a virus-like particle or pseudovirion, as described herein for delivery of the RNA (e.g., mRNA) vaccines of the present disclosure.

In some embodiments, RNA (e.g., mRNA) vaccine pharmaceutical compositions comprising the polynucleotides of the present disclosure and a conjugate that may have a degradable linkage. Non-limiting examples of conjugates include an aromatic moiety comprising an ionizable hydrogen atom, a spacer moiety, and a water-soluble polymer. As a non-limiting example, pharmaceutical compositions comprising a conjugate with a degradable linkage and methods for delivering such pharmaceutical compositions are described in U.S. Patent Publication No. US20130184443, the contents of which are herein incorporated by reference in their entirety.

The nanoparticle formulations may be a carbohydrate nanoparticle comprising a carbohydrate carrier and a RNA (e.g., mRNA) vaccine. As a non-limiting example, the carbohydrate carrier may include, but is not limited to, an anhydride-modified phytoglycogen or glycogen-type material, phytoglycogen octenyl succinate, phytoglycogen beta-dextrin, anhydride-modified phytoglycogen beta-dextrin. (See e.g., International Publication No. WO2012109121, the contents of which are herein incorporated by reference in their entirety).

Nanoparticle formulations of the present disclosure may be coated with a surfactant or polymer in order to improve the delivery of the particle. In some embodiments, the nanoparticle may be coated with a hydrophilic coating such as, but not limited to, PEG coatings and/or coatings that have a neutral surface charge. The hydrophilic coatings may help to deliver nanoparticles with larger payloads such as, but not limited to, RNA (e.g., mRNA) vaccines within the central nervous system. As a non-limiting example nanoparticles comprising a hydrophilic coating and methods of making such nanoparticles are described in U.S. Patent Publication No. US20130183244, the contents of which are herein incorporated by reference in their entirety.

In some embodiments, the lipid nanoparticles of the present disclosure may be hydrophilic polymer particles. Non-limiting examples of hydrophilic polymer particles and methods of making hydrophilic polymer particles are described in U.S. Patent Publication No. US20130210991, the contents of which are herein incorporated by reference in their entirety.

In some embodiments, the lipid nanoparticles of the present disclosure may be hydrophobic polymer particles.

Lipid nanoparticle formulations may be improved by replacing the cationic lipid with a biodegradable cationic lipid which is known as a rapidly eliminated lipid nanoparticle (reLNP). Ionizable cationic lipids, such as, but not limited to, DLinDMA, DLin-KC2-DMA, and DLin-MC3-DMA, have been shown to accumulate in plasma and tissues over time and may be a potential source of toxicity. The rapid metabolism of the rapidly eliminated lipids can improve the tolerability and therapeutic index of the lipid nanoparticles by an order of magnitude from a 1 mg/kg dose to a 10 mg/kg dose in rat. Inclusion of an enzymatically degraded ester linkage can improve the degradation and metabolism profile of the cationic component, while still maintaining the activity of the reLNP formulation. The ester linkage can be internally located within the lipid chain or it may be terminally located at the terminal end of the lipid chain. The internal ester linkage may replace any carbon in the lipid chain.

In some embodiments, the internal ester linkage may be located on either side of the saturated carbon.

In some embodiments, an immune response may be elicited by delivering a lipid nanoparticle which may include a nanospecies, a polymer and an immunogen. (U.S. Publication No. 20120189700 and International Publication No. WO2012099805; each of which is herein incorporated by reference in their entirety). The polymer may encapsulate the nanospecies or partially encapsulate the nanospecies. The immunogen may be a recombinant protein, a modified RNA and/or a polynucleotide described herein. In some embodiments, the lipid nanoparticle may be formulated for use in a vaccine such as, but not limited to, against a pathogen.

Lipid nanoparticles may be engineered to alter the surface properties of particles so the lipid nanoparticles may penetrate the mucosal barrier. Mucus is located on mucosal tissue such as, but not limited to, oral (e.g., the buccal and esophageal membranes and tonsil tissue), ophthalmic, gastrointestinal (e.g., stomach, small intestine, large intestine, colon, rectum), nasal, respiratory (e.g., nasal, pharyngeal, tracheal and bronchial membranes), genital (e.g., vaginal, cervical and urethral membranes). Nanoparticles larger than 10-200 nm which are preferred for higher drug encapsulation efficiency and the ability to provide the sustained delivery of a wide array of drugs have been thought to be too large to rapidly diffuse through mucosal barriers. Mucus is continuously secreted, shed, discarded or digested and recycled so most of the trapped particles may be removed from the mucosa tissue within seconds or within a few hours. Large polymeric nanoparticles (200 nm-500 nm in diameter) which have been coated densely with a low molecular weight polyethylene glycol (PEG) diffused through mucus only 4 to 6-fold lower than the same particles diffusing in water (Lai et al. PNAS 2007 104:1482-487; Lai et al. *Adv Drug Deliv Rev.* 2009 61: 158-171, each of which is herein incorporated by reference in their entirety). The transport of nanoparticles may be determined using rates of permeation and/or fluorescent microscopy techniques including, but not limited to, fluorescence recovery after photobleaching (FRAP) and high resolution multiple particle tracking (MPT). As a non-limiting example, compositions which can penetrate a mucosal barrier may be made as described in U.S. Pat. No. 8,241,670 or International Patent Publication No. WO2013110028, the contents of each of which are herein incorporated by reference in its entirety.

The lipid nanoparticle engineered to penetrate mucus may comprise a polymeric material (i.e, a polymeric core) and/or a polymer-vitamin conjugate and/or a tri-block co-polymer. The polymeric material may include, but is not limited to, polyamines, polyethers, polyamides, polyesters, polycarbamates, polyureas, polycarbonates, poly(styrenes), polyimides, polysulfones, polyurethanes, polyacetylenes, polyethylenes, polyethyeneimines, polyisocyanates, polyacrylates, polymethacrylates, polyacrylonitriles, and polyarylates. The polymeric material may be biodegradable and/or biocompatible. Non-limiting examples of biocompatible polymers are described in International Patent Publication No. WO2013116804, the contents of which are herein incorporated by reference in their entirety. The polymeric material may additionally be irradiated. As a non-limiting example, the polymeric material may be gamma irradiated (see e.g., International App. No. WO201282165, herein incorporated by reference in its entirety). Non-limiting examples of specific polymers include poly(caprolactone) (PCL), ethylene vinyl acetate polymer (EVA), poly(lactic acid) (PLA), poly(L-lactic acid) (PLLA), poly(glycolic acid) (PGA), poly (lactic acid-co-glycolic acid) (PLGA), poly(L-lactic acid-co-glycolic acid) (PLLGA), poly(D,L-lactide) (PDLA), poly (L-lactide) (PLLA), poly(D,L-lactide-co-caprolactone), poly(D,L-lactide-co-caprolactone-co-glycolide), poly(D,L-lactide-co-PEO-co-D,L-lactide), poly(D,L-lactide-co-PPO-co-D,L-lactide), polyalkyl cyanoacrylate, polyurethane, poly-L-lysine (PLL), hydroxypropyl methacrylate (HPMA), polyethyleneglycol, poly-L-glutamic acid, poly(hydroxy acids), polyanhydrides, polyorthoesters, poly(ester amides), polyamides, poly(ester ethers), polycarbonates, polyalkylenes such as polyethylene and polypropylene, polyalkylene glycols such as poly(ethylene glycol) (PEG), polyalkylene oxides (PEO), polyalkylene terephthalates such as poly (ethylene terephthalate), polyvinyl alcohols (PVA), polyvinyl ethers, polyvinyl esters such as poly(vinyl acetate), polyvinyl halides such as poly(vinyl chloride) (PVC), polyvinylpyrrolidone, polysiloxanes, polystyrene (PS), polyurethanes, derivatized celluloses such as alkyl celluloses, hydroxyalkyl celluloses, cellulose ethers, cellulose esters, nitro celluloses, hydroxypropylcellulose, carboxymethylcellulose, polymers of acrylic acids, such as poly(methyl(meth) acrylate) (PMMA), poly(ethyl(meth)acrylate), poly(butyl (meth)acrylate), poly(isobutyl(meth)acrylate), poly(hexyl (meth)acrylate), poly(isodecyl(meth)acrylate), poly(lauryl (meth)acrylate), poly(phenyl(meth)acrylate), poly(methyl acrylate), poly(isopropyl acrylate), poly(isobutyl acrylate), poly(octadecyl acrylate) and copolymers and mixtures thereof, polydioxanone and its copolymers, polyhydroxyalkanoates, polypropylene fumarate, polyoxymethylene, poloxamers, poly(ortho)esters, poly(butyric acid), poly(valeric acid), poly(lactide-co-caprolactone), PEG-PLGA-PEG and trimethylene carbonate, polyvinylpyrrolidone. The lipid nanoparticle may be coated or associated with a co-polymer such as, but not limited to, a block co-polymer (such as a branched polyether-polyamide block copolymer described in International Publication No. WO2013012476, herein incorporated by reference in its entirety), and (poly(ethylene glycol))-(poly(propylene oxide))-(poly(ethylene glycol)) triblock copolymer (see e.g., U.S. Publication 20120121718 and U.S. Publication 20100003337 and U.S. Pat. No. 8,263,665, the contents of each of which is herein incorporated by reference in their entirety). The co-polymer may be a polymer that is generally regarded as safe (GRAS) and the formation of the lipid nanoparticle may be in such a way that no new chemical entities are created. For example, the lipid nanoparticle may comprise poloxamers coating PLGA nanoparticles without forming new chemical entities which are still able to rapidly penetrate human mucus (Yang et al. Angew. Chem. Int. Ed. 2011 50:2597-2600; the contents of which are herein incorporated by reference in their entirety). A non-limiting scalable method to produce nanoparticles which can penetrate human mucus is described by Xu et al. (see. e.g., J Control Release 2013, 170:279-86; the contents of which are herein incorporated by reference in their entirety).

The vitamin of the polymer-vitamin conjugate may be vitamin E. The vitamin portion of the conjugate may be substituted with other suitable components such as, but not limited to, vitamin A, vitamin E, other vitamins, cholesterol, a hydrophobic moiety, or a hydrophobic component of other surfactants (e.g., sterol chains, fatty acids, hydrocarbon chains and alkylene oxide chains).

The lipid nanoparticle engineered to penetrate mucus may include surface altering agents such as, but not limited to, polynucleotides, anionic proteins (e.g., bovine serum albumin), surfactants (e.g., cationic surfactants such as for example dimethyldioctadecylammonium bromide), sugars or sugar derivatives (e.g., cyclodextrin), nucleic acids, polymers (e.g., heparin, polyethylene glycol and poloxamer), mucolytic agents (e.g., N-acetylcysteine, mugwort, bromelain, papain, clerodendrum, acetylcysteine, bromhexine, carbocisteine, eprazinone, mesna, ambroxol, sobrerol, domiodol, letosteine, stepronin, tiopronin, gelsolin, thymosin β4 dornase alfa, neltenexine, erdosteine) and various DNases including rhDNase. The surface altering agent may be embedded or enmeshed in the particle's surface or disposed (e.g., by coating, adsorption, covalent linkage, or other process) on the surface of the lipid nanoparticle. (see e.g., U.S. Publication 20100215580 and U.S. Publication 20080166414 and US20130164343; the contents of each of which are herein incorporated by reference in their entirety).

In some embodiments, the mucus penetrating lipid nanoparticles may comprise at least one polynucleotide described herein. The polynucleotide may be encapsulated in the lipid nanoparticle and/or disposed on the surface of the particle. The polynucleotide may be covalently coupled to the lipid nanoparticle. Formulations of mucus penetrating lipid nanoparticles may comprise a plurality of nanoparticles. Further, the formulations may contain particles which may interact with the mucus and alter the structural and/or adhesive properties of the surrounding mucus to decrease mucoadhesion, which may increase the delivery of the mucus penetrating lipid nanoparticles to the mucosal tissue.

In some embodiments, the mucus penetrating lipid nanoparticles may be a hypotonic formulation comprising a mucosal penetration enhancing coating. The formulation may be hypotonic for the epithelium to which it is being delivered. Non-limiting examples of hypotonic formulations may be found in International Patent Publication No. WO2013110028, the contents of which are herein incorporated by reference in their entirety.

In some embodiments, in order to enhance the delivery through the mucosal barrier the RNA (e.g., mRNA) vaccine formulation may comprise or be a hypotonic solution. Hypotonic solutions were found to increase the rate at which mucoinert particles such as, but not limited to, mucus-penetrating particles, were able to reach the vaginal epithelial surface (see e.g., Ensign et al. Biomaterials 2013 34(28): 6922-9, the contents of which are herein incorporated by reference in their entirety).

In some embodiments, the RNA (e.g., mRNA) vaccine is formulated as a lipoplex, such as, without limitation, the ATUPLEX™ system, the DACC system, the DBTC system and other siRNA-lipoplex technology from Silence Therapeutics (London, United Kingdom), STEMFECT™ from STEMGENT® (Cambridge, Mass.), and polyethylenimine (PEI) or protamine-based targeted and non-targeted delivery of nucleic acids (Aleku et al. Cancer Res. 2008 68:9788-9798; Strumberg et al. Int J Clin Pharmacol Ther 2012 50:76-78; Santel et al., Gene Ther 2006 13:1222-1234; Santel et al., Gene Ther 2006 13:1360-1370; Gutbier et al., Pulm Pharmacol. Ther. 2010 23:334-344; Kaufmann et al. Microvasc Res 2010 80:286-293 Weide et al. J Immunother. 2009 32:498-507; Weide et al. J Immunother. 2008 31:180-188; Pascolo Expert Opin. Biol. Ther. 4:1285-1294; Fotin-Mleczek et al., 2011 J. Immunother. 34:1-15; Song et al., Nature Biotechnol. 2005, 23:709-717; Peer et al., Proc Natl Acad Sci USA. 2007 6; 104:4095-4100; deFougerolles Hum Gene Ther. 2008 19:125-132, the contents of each of which are incorporated herein by reference in their entirety).

In some embodiments, such formulations may also be constructed or compositions altered such that they passively or actively are directed to different cell types in vivo, including but not limited to hepatocytes, immune cells, tumor cells, endothelial cells, antigen presenting cells, and leukocytes (Akinc et al. Mol Ther. 2010 18:1357-1364; Song et al., Nat Biotechnol. 2005 23:709-717; Judge et al., J Clin Invest. 2009 119:661-673; Kaufmann et al., Microvasc Res 2010 80:286-293; Santel et al., Gene Ther 2006 13:1222-1234; Santel et al., Gene Ther 2006 13:1360-1370; Gutbier et al., Pulm Pharmacol. Ther. 2010 23:334-344; Basha et al., Mol. Ther. 2011 19:2186-2200; Fenske and Cullis, Expert Opin Drug Deliv. 2008 5:25-44; Peer et al., Science. 2008 319:627-630; Peer and Lieberman, Gene Ther. 2011 18:1127-1133, the contents of each of which are incorporated herein by reference in their entirety). One example of passive targeting of formulations to liver cells includes the DLin-DMA, DLin-KC2-DMA and DLin-MC3-DMA-based lipid nanoparticle formulations, which have been shown to bind to apolipoprotein E and promote binding and uptake of these formulations into hepatocytes in vivo (Akinc et al. Mol Ther. 2010 18:1357-1364, the contents of which are incorporated herein by reference in their entirety). Formulations can also be selectively targeted through expression of different ligands on their surface as exemplified by, but not limited by, folate, transferrin, N-acetylgalactosamine (GalNAc), and antibody targeted approaches (Kolhatkar et al., Curr Drug Discov Technol. 2011 8:197-206; Musacchio and Torchilin, Front Biosci. 2011 16:1388-1412; Yu et al., Mol Membr Biol. 2010 27:286-298; Patil et al., Crit Rev Ther Drug Carrier Syst. 2008 25:1-61; Benoit et al., Biomacromolecules. 2011 12:2708-2714; Zhao et al., Expert Opin Drug Deliv. 2008 5:309-319; Akinc et al., Mol Ther. 2010 18:1357-1364; Srinivasan et al., Methods Mol Biol. 2012 820:105-116; Ben-Arie et al., Methods Mol Biol. 2012 757:497-507; Peer 2010 J Control Release. 20:63-68; Peer et al., Proc Natl Acad Sci USA. 2007 104:4095-4100; Kim et al., Methods Mol Biol. 2011 721:339-353; Subramanya et al., Mol Ther. 2010 18:2028-2037; Song et al., Nat Biotechnol. 2005 23:709-717; Peer et al., Science. 2008 319:627-630; Peer and Lieberman, Gene Ther. 2011 18:1127-1133, the contents of each of which are incorporated herein by reference in their entirety).

In some embodiments, the RNA (e.g., mRNA) vaccine is formulated as a solid lipid nanoparticle. A solid lipid nanoparticle (SLN) may be spherical with an average diameter between 10 to 1000 nm. SLN possess a solid lipid core matrix that can solubilize lipophilic molecules and may be stabilized with surfactants and/or emulsifiers. In some embodiments, the lipid nanoparticle may be a self-assembly lipid-polymer nanoparticle (see Zhang et al., ACS Nano, 2008, 2, pp 1696-1702; the contents of which are herein incorporated by reference in their entirety). As a non-limiting example, the SLN may be the SLN described in International Patent Publication No. WO2013105101, the contents of which are herein incorporated by reference in their entirety. As another non-limiting example, the SLN may be made by the methods or processes described in International Patent Publication No. WO2013105101, the contents of which are herein incorporated by reference in their entirety.

Liposomes, lipoplexes, or lipid nanoparticles may be used to improve the efficacy of polynucleotides directed protein production as these formulations may be able to increase cell transfection by the RNA (e.g., mRNA) vaccine; and/or increase the translation of encoded protein. One such example involves the use of lipid encapsulation to enable the effective systemic delivery of polyplex plasmid DNA (Heyes et al., Mol Ther. 2007 15:713-720; the contents of which are incorporated herein by reference in their entirety). The liposomes, lipoplexes, or lipid nanoparticles may also be used to increase the stability of the polynucleotide.

In some embodiments, the RNA (e.g., mRNA) vaccines of the present disclosure can be formulated for controlled release and/or targeted delivery. As used herein, "controlled release" refers to a pharmaceutical composition or compound release profile that conforms to a particular pattern of release to effect a therapeutic outcome. In some embodiments, the RNA (e.g., mRNA) vaccines may be encapsulated into a delivery agent described herein and/or known in the art for controlled release and/or targeted delivery. As used herein, the term "encapsulate" means to enclose, surround or encase. As it relates to the formulation of the compounds of the disclosure, encapsulation may be substantial, complete or partial. The term "substantially encapsulated" means that at least greater than 50, 60, 70, 80, 85, 90, 95, 96, 97, 98, 99, 99.9, 99.9 or greater than 99.999% of the pharmaceutical composition or compound of the disclosure may be enclosed, surrounded or encased within the delivery agent. "Partially encapsulation" means that less than 10, 10, 20, 30, 40 50 or less of the pharmaceutical composition or compound of the disclosure may be enclosed, surrounded or encased within the delivery agent. Advantageously, encapsulation may be determined by measuring the escape or the activity of the pharmaceutical composition or compound of the disclosure using fluorescence and/or electron micrograph. For example, at least 1, 5, 10, 20, 30, 40, 50, 60, 70, 80, 85, 90, 95, 96, 97, 98, 99, 99.9, 99.99 or greater than 99.99% of the pharmaceutical composition or compound of the disclosure are encapsulated in the delivery agent.

In some embodiments, the controlled release formulation may include, but is not limited to, tri-block co-polymers. As a non-limiting example, the formulation may include two different types of tri-block co-polymers (International Pub. No. WO2012131104 and WO02012131106, the contents of each of which are incorporated herein by reference in their entirety).

In some embodiments, the RNA (e.g., mRNA) vaccines may be encapsulated into a lipid nanoparticle or a rapidly eliminated lipid nanoparticle and the lipid nanoparticles or a rapidly eliminated lipid nanoparticle may then be encapsulated into a polymer, hydrogel and/or surgical sealant described herein and/or known in the art. As a non-limiting example, the polymer, hydrogel or surgical sealant may be PLGA, ethylene vinyl acetate (EVAc), poloxamer, GELSITE® (Nanotherapeutics, Inc. Alachua, Fla.), HYLENEX® (Halozyme Therapeutics, San Diego Calif.), surgical sealants such as fibrinogen polymers (Ethicon Inc. Cornelia, Ga.), TISSELL® (Baxter International, Inc Deerfield, Ill.), PEG-based sealants, and COSEAL® (Baxter International, Inc Deerfield, Ill.).

In some embodiments, the lipid nanoparticle may be encapsulated into any polymer known in the art which may form a gel when injected into a subject. As another non-limiting example, the lipid nanoparticle may be encapsulated into a polymer matrix which may be biodegradable.

In some embodiments, the RNA (e.g., mRNA) vaccine formulation for controlled release and/or targeted delivery, may also include at least one controlled release coating. Controlled release coatings include, but are not limited to, OPADRY®, polyvinylpyrrolidone/vinyl acetate copolymer, polyvinylpyrrolidone, hydroxypropyl methylcellulose, hydroxypropyl cellulose, hydroxyethyl cellulose, EUDRAGIT RL®, EUDRAGIT RS® and cellulose derivatives such as ethylcellulose aqueous dispersions (AQUACOAT® and SURELEASE®).

In some embodiments, the RNA (e.g., mRNA) vaccine controlled release and/or targeted delivery formulation may comprise at least one degradable polyester which may contain polycationic side chains. Degradable polyesters include, but are not limited to, poly(serine ester), poly(L-lactide-co-L-lysine), poly(4-hydroxy-L-proline ester), and combinations thereof. In some embodiments, the degradable polyesters may include a PEG conjugation to form a PEGylated polymer.

In some embodiments, the RNA (e.g., mRNA) vaccine controlled release and/or targeted delivery formulation comprising at least one polynucleotide may comprise at least one PEG and/or PEG related polymer derivatives as described in U.S. Pat. No. 8,404,222, the contents of which are incorporated herein by reference in their entirety.

In some embodiments, the RNA (e.g., mRNA) vaccine controlled release delivery formulation comprising at least one polynucleotide may be the controlled release polymer system described in US20130130348, the contents of which are incorporated herein by reference in their entirety.

In some embodiments, the RNA (e.g., mRNA) vaccines of the present disclosure may be encapsulated in a therapeutic nanoparticle, referred to herein as "therapeutic nanoparticle RNA (e.g., mRNA) vaccines." Therapeutic nanoparticles may be formulated by methods described herein and known in the art such as, but not limited to, International Pub Nos. WO2010005740, WO2010030763, WO2010005721, WO2010005723, WO2012054923, U.S. Publication Nos. US20110262491, US20100104645, US20100087337, US20100068285, US20110274759, US20100068286, US20120288541, US20130123351 and US20130230567 and U.S. Pat. Nos. 8,206,747, 8,293,276, 8,318,208 and 8,318,211; the contents of each of which are herein incorporated by reference in their entirety. In some embodiments, therapeutic polymer nanoparticles may be identified by the methods described in US Pub No. US20120140790, the contents of which are herein incorporated by reference in their entirety.

In some embodiments, the therapeutic nanoparticle RNA (e.g., mRNA) vaccine may be formulated for sustained release. As used herein. "sustained release" refers to a pharmaceutical composition or compound that conforms to a release rate over a specific period of time. The period of time may include, but is not limited to, hours, days, weeks, months and years. As a non-limiting example, the sustained release nanoparticle may comprise a polymer and a therapeutic agent such as, but not limited to, the polynucleotides of the present disclosure (see International Pub No. 2010075072 and US Pub No. US20100216804, US20110217377 and US20120201859, the contents of each of which are incorporated herein by reference in their entirety). In another non-limiting example, the sustained release formulation may comprise agents which permit persistent bioavailability such as, but not limited to, crystals, macromolecular gels and/or particulate suspensions (see U.S. Patent Publication No US20130150295, the contents of each of which are incorporated herein by reference in their entirety).

In some embodiments, the therapeutic nanoparticle RNA (e.g., mRNA) vaccines may be formulated to be target specific. As a non-limiting example, the therapeutic nanoparticles may include a corticosteroid (see International Pub. No. WO2011084518, the contents of which are incorporated herein by reference in their entirety). As a non-limiting example, the therapeutic nanoparticles may be formulated in nanoparticles described in International Pub No. WO2008121949, WO2010005726, WO2010005725, WO2011084521 and US Pub No. US20100069426, US20120004293 and US20100104655, the contents of each of which are incorporated herein by reference in their entirety.

In some embodiments, the nanoparticles of the present disclosure may comprise a polymeric matrix. As a non-limiting example, the nanoparticle may comprise two or more polymers such as, but not limited to, polyethylenes, polycarbonates, polyanhydrides, polyhydroxyacids, polypropylfumerates, polycaprolactones, polyamides, polyacetals, polyethers, polyesters, poly(orthoesters), polycyanoacrylates, polyvinyl alcohols, polyurethanes, polyphosphazenes, polyacrylates, polymethacrylates, polycyanoacrylates, polyureas, polystyrenes, polyamines, polylysine, poly(ethylene imine), poly(serine ester), poly(L-lactide-co-L-lysine), poly(4-hydroxy-L-proline ester) or combinations thereof.

In some embodiments, the therapeutic nanoparticle comprises a diblock copolymer. In some embodiments, the diblock copolymer may include PEG in combination with a polymer such as, but not limited to, polyethylenes, polycarbonates, polyanhydrides, polyhydroxyacids, polypropylfumerates, polycaprolactones, polyamides, polyacetals, polyethers, polyesters, poly(orthoesters), polycyanoacrylates, polyvinyl alcohols, polyurethanes, polyphosphazenes, polyacrylates, polymethacrylates, polycyanoacrylates, polyureas, polystyrenes, polyamines, polylysine, poly(ethylene imine), poly(serine ester), poly(L-lactide-co-L-lysine), poly(4-hydroxy-L-proline ester) or combinations thereof. In yet another embodiment, the diblock copolymer may be a high-X diblock copolymer such as those described in International Patent Publication No. WO2013120052, the contents of which are incorporated herein by reference in their entirety.

As a non-limiting example the therapeutic nanoparticle comprises a PLGA-PEG block copolymer (see U.S. Publication No. US20120004293 and U.S. Pat. No. 8,236,330, each of which is herein incorporated by reference in their entirety). In another non-limiting example, the therapeutic nanoparticle is a stealth nanoparticle comprising a diblock copolymer of PEG and PLA or PEG and PLGA (see U.S. Pat. No. 8,246,968 and International Publication No. WO2012166923, the contents of each of which are herein incorporated by reference in their entirety). In yet another non-limiting example, the therapeutic nanoparticle is a stealth nanoparticle or a target-specific stealth nanoparticle as described in U.S. Patent Publication No. US20130172406, the contents of which are herein incorporated by reference in their entirety.

In some embodiments, the therapeutic nanoparticle may comprise a multiblock copolymer (see e.g., U.S. Pat. Nos. 8,263,665 and 8,287,910 and U.S. Patent Pub. No. US20130195987, the contents of each of which are herein incorporated by reference in their entirety).

In yet another non-limiting example, the lipid nanoparticle comprises the block copolymer PEG-PLGA-PEG (see e.g., the thermosensitive hydrogel (PEG-PLGA-PEG) was used as a TGF-beta1 gene delivery vehicle in Lee et al. Thermosensitive Hydrogel as a TGF-β1 Gene Delivery Vehicle Enhances Diabetic Wound Healing. Pharmaceutical Research, 2003 20(12): 1995-2000; as a controlled gene delivery system in Li et al. Controlled Gene Delivery System Based on Thermosensitive Biodegradable Hydrogel. Pharmaceutical Research 2003 20:884-888; and Chang et al., Non-ionic amphiphilic biodegradable PEG-PLGA-PEG copolymer enhances gene delivery efficiency in rat skeletal muscle. J Controlled Release. 2007 118:245-253, the contents of each of which are herein incorporated by reference in their entirety). The RNA (e.g., mRNA) vaccines of the present disclosure may be formulated in lipid nanoparticles comprising the PEG-PLGA-PEG block copolymer.

In some embodiments, the therapeutic nanoparticle may comprise a multiblock copolymer (see e.g., U.S. Pat. Nos. 8,263,665 and 8,287,910 and U.S. Patent Pub. No. US20130195987, the contents of each of which are herein incorporated by reference in their entirety).

In some embodiments, the block copolymers described herein may be included in a polyion complex comprising a non-polymeric micelle and the block copolymer. (see e.g., U.S. Publication No. 20120076836, the contents of which are herein incorporated by reference in their entirety).

In some embodiments, the therapeutic nanoparticle may comprise at least one acrylic polymer. Acrylic polymers include but are not limited to, acrylic acid, methacrylic acid, acrylic acid and methacrylic acid copolymers, methyl methacrylate copolymers, ethoxyethyl methacrylates, cyanoethyl methacrylate, amino alkyl methacrylate copolymer, poly (acrylic acid), poly(methacrylic acid), polycyanoacrylates and combinations thereof.

In some embodiments, the therapeutic nanoparticles may comprise at least one poly(vinyl ester) polymer. The poly (vinyl ester) polymer may be a copolymer such as a random copolymer. As a non-limiting example, the random copolymer may have a structure such as those described in International Application No. WO2013032829 or U.S. Patent Publication No US20130121954, the contents of each of which are herein incorporated by reference in their entirety. In some embodiments, the poly(vinyl ester) polymers may be conjugated to the polynucleotides described herein.

In some embodiments, the therapeutic nanoparticle may comprise at least one diblock copolymer. The diblock copolymer may be, but it not limited to, a poly(lactic) acid-poly (ethylene)glycol copolymer (see. e.g., International Patent Publication No. WO2013044219, the contents of which are herein incorporated by reference in their entirety). As a non-limiting example, the therapeutic nanoparticle may be used to treat cancer (see International publication No. WO2013044219, the contents of which are herein incorporated by reference in their entirety).

In some embodiments, the therapeutic nanoparticles may comprise at least one cationic polymer described herein and/or known in the art.

In some embodiments, the therapeutic nanoparticles may comprise at least one amine-containing polymer such as, but not limited to polylysine, polyethylene imine, poly(amido-amine) dendrimers, poly(beta-amino esters) (see, e.g., U.S. Pat. No. 8,287,849, the contents of which are herein incorporated by reference in their entirety) and combinations thereof.

In some embodiments, the nanoparticles described herein may comprise an amine cationic lipid such as those described in International Patent Application No. WO2013059496, the contents of which are herein incorporated by reference in their entirety. In some embodiments, the cationic lipids may have an amino-amine or an amino-amide moiety.

In some embodiments, the therapeutic nanoparticles may comprise at least one degradable polyester which may contain polycationic side chains. Degradable polyesters include, but are not limited to, poly(serine ester), poly(L-lactide-co-L-lysine), poly(4-hydroxy-L-proline ester), and combinations thereof. In some embodiments, the degradable polyesters may include a PEG conjugation to form a PEGylated polymer.

In some embodiments, the synthetic nanocarriers may contain an immunostimulatory agent to enhance the immune response from delivery of the synthetic nanocarrier. As a non-limiting example, the synthetic nanocarrier may comprise a Th1 immunostimulatory agent, which may enhance a Th1-based response of the immune system (see International Pub No. WO2010123569 and U.S. Publication No. US20110223201, the contents of each of which are herein incorporated by reference in their entirety).

In some embodiments, the synthetic nanocarriers may be formulated for targeted release. In some embodiments, the synthetic nanocarrier is formulated to release the polynucleotides at a specified pH and/or after a desired time interval. As a non-limiting example, the synthetic nanoparticle may be formulated to release the RNA (e.g., mRNA) vaccines after 24 hours and/or at a pH of 4.5 (see International Publication Nos. WO2010138193 and WO2010138194 and US Pub Nos. US20110020388 and US20110027217, each of which is herein incorporated by reference in their entireties).

In some embodiments, the synthetic nanocarriers may be formulated for controlled and/or sustained release of the polynucleotides described herein. As a non-limiting example, the synthetic nanocarriers for sustained release may be formulated by methods known in the art, described herein and/or as described in International Pub No. WO2010138192 and US Pub No. 20100303850, each of which is herein incorporated by reference in their entirety.

In some embodiments, the RNA (e.g., mRNA) vaccine may be formulated for controlled and/or sustained release wherein the formulation comprises at least one polymer that is a crystalline side chain (CYSC) polymer. CYSC polymers are described in U.S. Pat. No. 8,399,007, herein incorporated by reference in its entirety.

In some embodiments, the synthetic nanocarrier may be formulated for use as a vaccine. In some embodiments, the synthetic nanocarrier may encapsulate at least one polynucleotide which encode at least one antigen. As a non-limiting example, the synthetic nanocarrier may include at least one antigen and an excipient for a vaccine dosage form (see International Publication No. WO2011150264 and U.S. Publication No. US20110293723, the contents of each of which are herein incorporated by reference in their entirety). As another non-limiting example, a vaccine dosage form may include at least two synthetic nanocarriers with the same or different antigens and an excipient (see International Publication No. WO2011150249 and U.S. Publication No. US20110293701, the contents of each of which are herein incorporated by reference in their entirety). The vaccine dosage form may be selected by methods described herein, known in the art and/or described in International Publication No. WO2011150258 and U.S. Publication No. US20120027806, the contents of each of which are herein incorporated by reference in their entirety).

In some embodiments, the synthetic nanocarrier may comprise at least one polynucleotide which encodes at least one adjuvant. As non-limiting example, the adjuvant may comprise dimethyldioctadecylammonium-bromide, dimethyldioctadecylammonium-chloride, dimethyldioctadecylammonium-phosphate or dimethyldioctadecylammonium-acetate (DDA) and an apolar fraction or part of said apolar fraction of a total lipid extract of a mycobacterium (see, e.g., U.S. Pat. No. 8,241,610, the content of which is herein incorporated by reference in its entirety). In some embodiments, the synthetic nanocarrier may comprise at least one polynucleotide and an adjuvant. As a non-limiting example, the synthetic nanocarrier comprising and adjuvant may be formulated by the methods described in International Publication No. WO2011150240 and U.S. Publication No. US20110293700, the contents of each of which are herein incorporated by reference in their entirety.

In some embodiments, the synthetic nanocarrier may encapsulate at least one polynucleotide that encodes a peptide, fragment or region from a virus. As a non-limiting example, the synthetic nanocarrier may include, but is not limited to, any of the nanocarriers described in International Publication No. WO2012024621, WO201202629, WO2012024632 and U.S. Publication No. US20120064110, US20120058153 and US20120058154, the contents of each of which are herein incorporated by reference in their entirety.

In some embodiments, the synthetic nanocarrier may be coupled to a polynucleotide which may be able to trigger a humoral and/or cytotoxic T lymphocyte (CTL) response (see, e.g., International Publication No. WO2013019669, the contents of which are herein incorporated by reference in their entirety).

In some embodiments, the RNA (e.g., mRNA) vaccine may be encapsulated in, linked to and/or associated with zwitterionic lipids. Non-limiting examples of zwitterionic lipids and methods of using zwitterionic lipids are described in U.S. Patent Publication No. US20130216607, the contents of which are herein incorporated by reference in their entirety. In some aspects, the zwitterionic lipids may be used in the liposomes and lipid nanoparticles described herein.

In some embodiments, the RNA (e.g., mRNA) vaccine may be formulated in colloid nanocarriers as described in U.S. Patent Publication No. US20130197100, the contents of which are herein incorporated by reference in their entirety.

In some embodiments, the nanoparticle may be optimized for oral administration. The nanoparticle may comprise at least one cationic biopolymer such as, but not limited to, chitosan or a derivative thereof. As a non-limiting example, the nanoparticle may be formulated by the methods described in U.S. Publication No. 20120282343, the contents of which are herein incorporated by reference in their entirety.

In some embodiments, LNPs comprise the lipid KL52 (an amino-lipid disclosed in U.S. Application Publication No. 2012/0295832, the contents of which are herein incorporated by reference in their entirety. Activity and/or safety (as measured by examining one or more of ALT/AST, white blood cell count and cytokine induction, for example) of LNP administration may be improved by incorporation of such lipids. LNPs comprising KL52 may be administered intravenously and/or in one or more doses. In some embodiments, administration of LNPs comprising KL52 results in equal or improved mRNA and/or protein expression as compared to LNPs comprising MC3.

In some embodiments, RNA (e.g., mRNA) vaccine may be delivered using smaller LNPs. Such particles may comprise a diameter from below 0.1 um up to 100 nm such as, but not limited to, less than 0.1 um, less than 1.0 um, less than 5 um, less than 10 um, less than 15 um, less than 20 um, less than 25 um, less than 30 um, less than 35 um, less than 40 um less than 50 um less than 55 um, less than 60 um, less than 65 um, less than 70 um, less than 75 um, less than 80 um, less than 85 um, less than 90 um, less than 95 um, less than 100 um, less than 125 um, less than 150 um, less than 175 um, less than 200 um, less than 225 um, less than 250 um, less than 275 um, less than 300 um, less than 325 um, less than 350 um, less than 375 um, less than 400 um, less than 425 um, less than 450 um, less than 475 um, less than 500 um, less than 525 um, less than 550 um, less than 575 um, less than 600 um, less than 625 um, less than 650 um, less than 675 um, less than 700 um, less than 725 um, less than 750 um, less than 775 um, less than 800 um, less than 825 um, less than 850 um, less than 875 um, less than 900 um, less than 925 um, less than 950 um, less than 975 um, or less than 1000 um.

In some embodiments, RNA (e.g., mRNA) vaccines may be delivered using smaller LNPs, which may comprise a diameter from about 1 nm to about 100 nm, from about 1 nm to about 10 nm, about 1 nm to about 20 nm, from about 1 nm to about 30 nm, from about 1 nm to about 40 nm, from about 1 nm to about 50 nm, from about 1 nm to about 60 nm, from about 1 nm to about 70 nm, from about 1 nm to about 80 nm, from about 1 nm to about 90 nm, from about 5 nm to about from 100 nm, from about 5 nm to about 10 nm, about 5 nm to about 20 nm, from about 5 nm to about 30 nm, from about 5 nm to about 40 nm, from about 5 nm to about 50 nm, from about 5 nm to about 60 nm, from about 5 nm to about 70 nm, from about 5 nm to about 80 nm, from about 5 nm to about 90 nm, about 10 to about 50 nm, from about 20 to about 50 nm, from about 30 to about 50 nm, from about 40 to about 50 nm, from about 20 to about 60 nm, from about 30 to about 60 nm, from about 40 to about 60 nm, from about 20 to about 70 nm, from about 30 to about 70 nm, from about 40 to about 70 nm, from about 50 to about 70 nm, from about 60 to about 70 nm, from about 20 to about 80 nm, from about 30 to about 80 nm, from about 40 to about 80 nm, from about 50 to about 80 nm, from about 60 to about 80 nm, from about 20 to about 90 nm, from about 30 to about 90 nm, from about 40 to about 90 nm, from about 50 to about 90 nm, from about 60 to about 90 nm and/or from about 70 to about 90 nm.

In some embodiments, such LNPs are synthesized using methods comprising microfluidic mixers. Examples of microfluidic mixers may include, but are not limited to, a slit interdigital micromixer including, but not limited to those manufactured by Microinnova (Allerheiligen bei Wildon, Austria) and/or a staggered herringbone micromixer (SHM) (Zhigaltsev, I. V. et al., Bottom-up design and synthesis of limit size lipid nanoparticle systems with aqueous and triglyceride cores using millisecond microfluidic mixing have been published (Langmuir. 2012. 28:3633-40; Belliveau, N. M. et al., Microfluidic synthesis of highly potent limit-size lipid nanoparticles for in vivo delivery of siRNA. Molecular Therapy-Nucleic Acids. 2012. 1:e37; Chen, D. et al., Rapid discovery of potent siRNA-containing lipid nanoparticles enabled by controlled microfluidic formulation. J Am Chem Soc. 2012. 134(16):6948-51, the contents of each of which are herein incorporated by reference in their entirety). In some embodiments, methods of LNP generation comprising SHM, further comprise the mixing of at least two input streams wherein mixing occurs by microstructure-induced chaotic advection (MICA). According to this method, fluid streams flow through channels present in a herringbone pattern causing rotational flow and folding the fluids around each other. This method may also comprise a surface for fluid mixing wherein the surface changes orientations during fluid cycling. Methods of generating LNPs using SHM include those disclosed in U.S. Application Publication Nos. 2004/0262223 and 2012/0276209, the contents of each of which are herein incorporated by reference in their entirety.

In some embodiments, the RNA (e.g., mRNA) vaccine of the present disclosure may be formulated in lipid nanoparticles created using a micromixer such as, but not limited to, a Slit Interdigital Microstructured Mixer (SIMM-V2) or a Standard Slit Interdigital Micro Mixer (SSIMM) or Caterpillar (CPMM) or Impinging-jet (IJMM) from the Institut für Mikrotechnik Mainz GmbH, Mainz Germany).

In some embodiments, the RNA (e.g., mRNA) vaccines of the present disclosure may be formulated in lipid nanoparticles created using microfluidic technology (see. e.g., Whitesides, George M. The Origins and the Future of Microfluidics. Nature, 2006 442: 368-373, and Abraham et al. Chaotic Mixer for Microchannels. Science, 2002 295; 647-651; each of which is herein incorporated by reference in its entirety). As a non-limiting example, controlled microfluidic formulation includes a passive method for mixing streams of steady pressure-driven flows in micro channels at a low Reynolds number (see, e.g., Abraham et al. Chaotic Mixer for Microchannels. Science, 2002 295: 647-651, the contents of which are herein incorporated by reference in their entirety).

In some embodiments, the RNA (e.g., mRNA) vaccines of the present disclosure may be formulated in lipid nanoparticles created using a micromixer chip such as, but not limited to, those from Harvard Apparatus (Holliston, Mass.) or Dolomite Microfluidics (Royston. UK). A micromixer chip can be used for rapid mixing of two or more fluid streams with a split and recombine mechanism.

In some embodiments, the RNA (e.g., mRNA) vaccines of the disclosure may be formulated for delivery using the drug encapsulating microspheres described in International Patent Publication No. WO2013063468 or U.S. Pat. No. 8,440,614, the contents of each of which are herein incorporated by reference in their entirety. The microspheres may comprise a compound of the formula (I), (II), (III), (IV), (V) or (VI) as described in International Patent Publication No. WO2013063468, the contents of which are herein incorporated by reference in their entirety. In some embodiments, the amino acid, peptide, polypeptide, lipids (APPL) are useful in delivering the RNA (e.g., mRNA) vaccines of the disclosure to cells (see International Patent Publication No. WO2013063468, the contents of which are herein incorporated by reference in their entirety).

In some embodiments, the RNA (e.g., mRNA) vaccines of the disclosure may be formulated in lipid nanoparticles having a diameter from about 10 to about 100 nm such as, but not limited to, about 10 to about 20 nm, about 10 to about 30 nm, about 10 to about 40 nm, about 10 to about 50 nm, about 10 to about 60 nm, about 10 to about 70 nm, about 10 to about 80 nm, about 10 to about 90 nm, about 20 to about 30 nm, about 20 to about 40 nm, about 20 to about 50 nm, about 20 to about 60 nm, about 20 to about 70 nm, about 20 to about 80 nm, about 20 to about 90 nm, about 20 to about 100 nm, about 30 to about 40 nm, about 30 to about 50 nm, about 30 to about 60 nm, about 30 to about 70 nm, about 30 to about 80 nm, about 30 to about 90 nm, about 30 to about 100 nm, about 40 to about 50 nm, about 40 to about 60 nm, about 40 to about 70 nm, about 40 to about 80 nm, about 40 to about 90 nm, about 40 to about 100 nm, about 50 to about 60 nm, about 50 to about 70 nm about 50 to about 80 nm, about 50 to about 90 nm, about 50 to about 100 nm, about 60 to about 70 nm, about 60 to about 80 nm, about 60 to about 90 nm, about 60 to about 100 nm, about 70 to about 80 nm, about 70 to about 90 nm, about 70 to about 100 nm, about 80 to about 90 nm, about 80 to about 100 nm and/or about 90 to about 100 nm.

In some embodiments, the lipid nanoparticles may have a diameter from about 10 to 500 nm.

In some embodiments, the lipid nanoparticle may have a diameter greater than 100 nm, greater than 150 nm, greater than 200 nm, greater than 250 nm, greater than 300 nm, greater than 350 nm, greater than 400 nm, greater than 450 nm, greater than 500 nm, greater than 550 nm, greater than 600 nm, greater than 650 nm, greater than 700 nm, greater than 750 nm, greater than 800 nm, greater than 850 nm, greater than 900 nm, greater than 950 nm or greater than 1000 nm.

In some embodiments, the lipid nanoparticle may be a limit size lipid nanoparticle described in International Patent Publication No. WO2013059922, the contents of which are herein incorporated by reference in their entirety. The limit size lipid nanoparticle may comprise a lipid bilayer surrounding an aqueous core or a hydrophobic core; where the lipid bilayer may comprise a phospholipid such as, but not limited to, diacylphosphatidylcholine, a diacylphosphatidylethanolamine, a ceramide, a sphingomyelin, a dihydrosphingomyelin, a cephalin, a cerebroside, a C8-C20 fatty acid diacylphophatidylcholine, and 1-palmitoyl-2-oleoyl phosphatidylcholine (POPC). In some embodiments, the limit size lipid nanoparticle may comprise a polyethylene glycol-lipid such as, but not limited to, DLPE-PEG, DMPE-PEG, DPPC-PEG and DSPE-PEG.

In some embodiments, the RNA (e.g., mRNA) vaccines may be delivered, localized and/or concentrated in a specific location using the delivery methods described in International Patent Publication No. WO2013063530, the contents of which are herein incorporated by reference in their entirety. As a non-limiting example, a subject may be administered an empty polymeric particle prior to, simultaneously with or after delivering the RNA (e.g., mRNA) vaccines to the subject. The empty polymeric particle undergoes a change in volume once in contact with the subject and becomes lodged, embedded, immobilized or entrapped at a specific location in the subject.

In some embodiments, the RNA (e.g., mRNA) vaccines may be formulated in an active substance release system (see, e.g., U.S. Patent Publication No. US20130102545, the contents of which are herein incorporated by reference in their entirety). The active substance release system may comprise 1) at least one nanoparticle bonded to an oligonucleotide inhibitor strand which is hybridized with a catalytically active nucleic acid and 2) a compound bonded to at least one substrate molecule bonded to a therapeutically active substance (e.g., polynucleotides described herein), where the therapeutically active substance is released by the cleavage of the substrate molecule by the catalytically active nucleic acid.

In some embodiments, the RNA (e.g., mRNA) vaccines may be formulated in a nanoparticle comprising an inner core comprising a non-cellular material and an outer surface comprising a cellular membrane. The cellular membrane may be derived from a cell or a membrane derived from a virus. As a non-limiting example, the nanoparticle may be made by the methods described in International Patent Publication No. WO02013052167, the contents of which are herein incorporated by reference in their entirety. As another non-limiting example, the nanoparticle described in International Patent Publication No. WO02013052167, the contents of which are herein incorporated by reference in their entirety, may be used to deliver the RNA (e.g., mRNA) vaccines described herein.

In some embodiments, the RNA (e.g., mRNA) vaccines may be formulated in porous nanoparticle-supported lipid bilayers (protocells). Protocells are described in International Patent Publication No. WO2013056132, the contents of which are herein incorporated by reference in their entirety.

In some embodiments, the RNA (e.g., mRNA) vaccines described herein may be formulated in polymeric nanoparticles as described in or made by the methods described in U.S. Pat. Nos. 8,420,123 and 8,518,963 and European Patent No. EP2073848B1, the contents of each of which are herein incorporated by reference in their entirety. As a non-limiting example, the polymeric nanoparticle may have a high glass transition temperature such as the nanoparticles described in or nanoparticles made by the methods described in U.S. Pat. No. 8,518,963, the contents of which are herein incorporated by reference in their entirety. As another non-limiting example, the polymer nanoparticle for oral and parenteral formulations may be made by the methods described in European Patent No. EP2073848B1, the contents of which are herein incorporated by reference in their entirety.

In some embodiments, the RNA (e.g., mRNA) vaccines described herein may be formulated in nanoparticles used in imaging. The nanoparticles may be liposome nanoparticles such as those described in U.S. Patent Publication No US20130129636, herein incorporated by reference in its entirety. As a non-limiting example, the liposome may comprise gadolinium(III)2-{4,7-bis-carboxymethyl-10-[(N, N-distearylamidomethyl-N'-amido-methyl]-1,4,7,10-tetra-azacyclododec-1-yl}-acetic acid and a neutral, fully saturated phospholipid component (see. e.g., U.S. Patent Publication No US20130129636, the contents of which are herein incorporated by reference in their entirety).

In some embodiments, the nanoparticles which may be used in the present disclosure are formed by the methods described in U.S. Patent Application No. US20130130348, the contents of which are herein incorporated by reference in their entirety.

The nanoparticles of the present disclosure may further include nutrients such as, but not limited to, those which deficiencies can lead to health hazards from anemia to neural tube defects (see, e.g., the nanoparticles described in International Patent Publication No WO2013072929, the contents of which are herein incorporated by reference in their entirety). As a non-limiting example, the nutrient may be iron in the form of ferrous, ferric salts or elemental iron, iodine, folic acid, vitamins or micronutrients.

In some embodiments, the RNA (e.g., mRNA) vaccines of the present disclosure may be formulated in a swellable nanoparticle. The swellable nanoparticle may be, but is not limited to, those described in U.S. Pat. No. 8,440,231, the contents of which are herein incorporated by reference in their entirety. As a non-limiting embodiment, the swellable nanoparticle may be used for delivery of the RNA (e.g., mRNA) vaccines of the present disclosure to the pulmonary system (see, e.g., U.S. Pat. No. 8,440,231, the contents of which are herein incorporated by reference in their entirety).

The RNA (e.g., mRNA) vaccines of the present disclosure may be formulated in polyanhydride nanoparticles such as, but not limited to, those described in U.S. Pat. No. 8,449,916, the contents of which are herein incorporated by reference in their entirety.

The nanoparticles and microparticles of the present disclosure may be geometrically engineered to modulate macrophage and/or the immune response. In some embodiments, the geometrically engineered particles may have varied shapes, sizes and/or surface charges in order to incorporated the polynucleotides of the present disclosure for targeted delivery such as, but not limited to, pulmonary delivery (see, e.g., International Publication No WO2013082111, the contents of which are herein incorporated by reference in their entirety). Other physical features the geometrically engineering particles may have include, but are not limited to, fenestrations, angled arms, asymmetry and surface roughness, charge which can alter the interactions with cells and tissues. As a non-limiting example, nanoparticles of the present disclosure may be made by the methods described in International Publication No WO2013082111, the contents of which are herein incorporated by reference in their entirety.

In some embodiments, the nanoparticles of the present disclosure may be water soluble nanoparticles such as, but not limited to, those described in International Publication No. WO2013090601, the contents of which are herein incorporated by reference in their entirety. The nanoparticles may be inorganic nanoparticles which have a compact and zwitterionic ligand in order to exhibit good water solubility. The nanoparticles may also have small hydrodynamic diameters (HD), stability with respect to time, pH, and salinity and a low level of non-specific protein binding.

In some embodiments the nanoparticles of the present disclosure may be developed by the methods described in U.S. Patent Publication No. US20130172406, the contents of which are herein incorporated by reference in their entirety.

In some embodiments, the nanoparticles of the present disclosure are stealth nanoparticles or target-specific stealth nanoparticles such as, but not limited to, those described in U.S. Patent Publication No. US20130172406, the contents of which are herein incorporated by reference in their entirety. The nanoparticles of the present disclosure may be made by the methods described in U.S. Patent Publication No. US20130172406, the contents of which are herein incorporated by reference in their entirety.

In some embodiments, the stealth or target-specific stealth nanoparticles may comprise a polymeric matrix. The polymeric matrix may comprise two or more polymers such as, but not limited to, polyethylenes, polycarbonates, polyanhydrides, polyhydroxyacids, polypropylfumerates, polycaprolactones, polyamides, polyacetals, polyethers, polyesters, poly(orthoesters), polycyanoacrylates, polyvinyl alcohols, polyurethanes, polyphosphazenes, polyacrylates, polymethacrylates, polycyanoacrylates, polyureas, polystyrenes, polyamines, polyesters, polyanhydrides, polyethers, polyurethanes, polymethacrylates, polyacrylates, polycyanoacrylates or combinations thereof.

In some embodiments, the nanoparticle may be a nanoparticle-nucleic acid hybrid structure having a high density nucleic acid layer. As a non-limiting example, the nanoparticle-nucleic acid hybrid structure may made by the methods described in U.S. Patent Publication No. US20130171646, the contents of which are herein incorporated by reference in their entirety. The nanoparticle may comprise a nucleic acid such as, but not limited to, polynucleotides described herein and/or known in the art.

At least one of the nanoparticles of the present disclosure may be embedded in the core a nanostructure or coated with a low density porous 3-D structure or coating which is capable of carrying or associating with at least one payload within or on the surface of the nanostructure. Non-limiting examples of the nanostructures comprising at least one nanoparticle are described in International Patent Publication No. WO02013123523, the contents of which are herein incorporated by reference in their entirety.

In some embodiments the RNA (e.g., mRNA) vaccine may be associated with a cationic or polycationic compounds, including protamine, nucleoline, spermine or spermidine, or other cationic peptides or proteins, such as poly-L-lysine (PLL), polyarginine, basic polypeptides, cell penetrating peptides (CPPs), including HIV-binding peptides, HIV-1 Tat (HIV), Tat-derived peptides, Penetratin, VP[22] derived or analog peptides, Pestivirus Erns, HSV. VP[22] (Herpes simplex), MAP, KALA or protein transduction domains (PTDs), PpT620, prolin-rich peptides, arginine-rich peptides, lysine-rich peptides, MPG-peptide(s), Pep-1, L-oligomers, Calcitonin peptide(s), Antennapedia-derived peptides (particularly from Drosophila antennapedia), pAntp, pIsl, FGF, Lactoferrin, Transportan, Buforin-2, Bac715-24. SynB, SynB, pVEC, hCT-derived peptides, SAP, histones, cationic polysaccharides, for example chitosan, polybrene, cationic polymers, e.g. polyethyleneimine (PEI), cationic lipids, e.g. DOTMA: [1-(2,3-sioleyloxy)propyl)]-N,N,N-trimethylammonium chloride, DMRIE, di-C14-amidine, DOTIM, SAINT, DC-Chol, BGTC, CTAP, DOPC, DODAP, DOPE: Dioleyl phosphatidylethanolamine, DOSPA, DODAB, DOIC, DMEPC, DOGS: Dioctadecylamidoglicylspermin, DIMRI; Dimyristooxypropyl dimethyl hydroxyethyl ammonium bromide, DOTAP: dioleoyloxy-3-(trimethylammonio)propane, DC-6-14: O,O-ditetradecanoyl-N-.alpha.-trimethylammonioacetyl)diethanolamine chloride, CLIP 1: rac-[(2,3-dioctadecyloxypropyl)(2-hydroxyethyl)]-dimethylammonium chloride, CLIP6: rac-[2(2,3-dihexadecyloxypropyloxymethyloxy)ethyl]-trimethylammonium, CLIP9: rac-[2(2,3-dihexadecyloxypropyloxysuccinyloxy)ethyl]-trimethylammo-nium, oligofectamine, or cationic or polycationic polymers, e.g. modified polyaminoacids, such as beta-aminoacid-polymers or reversed polyamides, etc., modified polyethylenes, such as PVP (poly(N-ethyl-4-vinylpyridinium bromide)), etc., modified acrylates, such as pDMAEMA (poly(dimethylaminoethyl methylacrylate)), etc., modified amidoamines such as pAMAM (poly(amidoamine)), etc., modified polybetaminoester (PBAE), such as diamine end modified 1,4 butanediol diacrylate-co-5-amino-1-pentanol polymers, etc., dendrimers, such as polypropylamine dendrimers or pAMAM based dendrimers, etc., polyimine(s), such as PEI: poly(ethyleneimine), poly(propyleneimine), etc., polyallylamine, sugar backbone based polymers, such as cyclodextrin based polymers, dextran based polymers, chitosan, etc., silan backbone based polymers, such as PMOXA-PDMS copolymers, etc., blockpolymers consisting of a combination of one or more cationic blocks (e.g. selected from a cationic polymer as mentioned above) and of one or more hydrophilic or hydrophobic blocks (e.g. polyethyleneglycole), etc.

In other embodiments the RNA (e.g., mRNA) vaccine is not associated with a cationic or polycationic compounds.

In some embodiments, a nanoparticle comprises compounds of Formula (I):

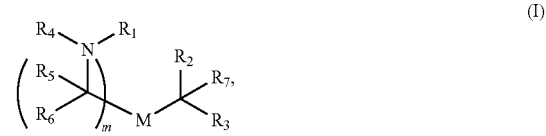

or a salt or isomer thereof, wherein:

$R_1$ is selected from the group consisting of $C_{5-30}$ alkyl, $C_{5-20}$ alkenyl, —R*YR", —YR", and —R"M'R';

$R_2$ and $R_3$ are independently selected from the group consisting of H, $C_{1-14}$ alkyl, $C_{2-14}$ alkenyl, —R*YR", —YR", and —R*OR", or $R_2$ and $R_3$, together with the atom to which they are attached, form a heterocycle or carbocycle;

$R_4$ is selected from the group consisting of a $C_{3-6}$ carbocycle, —$(CH_2)_nQ$, —$(CH_2)_n$CHQR,
—CHQR, —CQ$(R)_2$, and unsubstituted $C_{1-6}$ alkyl, where Q is selected from a carbocycle, heterocycle, —OR, —O$(CH_2)_n$N$(R)_2$, —C(O)OR, —OC(O)R, —CX$_3$, —CX$_2$H, —CXH$_2$, —CN, —N$(R)_2$, —C(O)N$(R)_2$, —N(R)C(O)R, —N(R)S(O)$_2$R, —N(R)C(O)N$(R)_2$, —N(R)C(S)N$(R)_2$, —N(R)R$_8$, —O$(CH_2)_n$OR, —N(R)C(=NR$_9$)N$(R)_2$, —N(R)C(=CHR$_9$)N$(R)_2$, —OC(O)N$(R)_2$, —N(R)C(O)OR, —N(R)C(O)R, —N(R)S(O)$_2$R, —N(OR)C(O)OR, —N(OR)C(O)N$(R)_2$, —N(OR)C(S)N$(R)_2$, —N(OR)C(=NR$_9$)N$(R)_2$, —N(OR)C(=CHR$_9$)N$(R)_2$, —C(=NR$_9$)N (R)$_2$, —C(=NR$_9$)R, —C(O)N(R)O R, and —C(R)N(R)$_2$C(O)OR, and each n is independently selected from 1, 2, 3, 4, and 5;

each R$_5$ is independently selected from the group consisting of C$_{1-3}$ alkyl, C$_{2-3}$ alkenyl, and H;

each R$_6$ is independently selected from the group consisting of C$_{1-3}$ alkyl, C$_{2-3}$ alkenyl, and H;

M and M' are independently selected from —C(O)O—, —OC(O)—, —C(O)N(R')—, —N(R')C(O)—, —C(O)—, —C(S)—, —C(S)S—, —SC(S)—, —CH(OH)—, —P(O)(OR')O—, —S(O)$_2$—, —S—S—, an aryl group, and a heteroaryl group:

R$_7$ is selected from the group consisting of C$_{1-3}$ alkyl, C$_{2-3}$ alkenyl, and H;

R$_8$ is selected from the group consisting of C$_{3-6}$ carbocycle and heterocycle;

R$_9$ is selected from the group consisting of H, CN, NO$_2$, C$_{1-6}$ alkyl, —OR, —S(O)$_2$R, —S(O)$_2$N(R)$_2$, C$_{2-6}$ alkenyl, C$_{3-6}$ carbocycle and heterocycle:

each R is independently selected from the group consisting of C$_{1-3}$ alkyl, C$_{2-3}$ alkenyl, and H;

each R' is independently selected from the group consisting of C$_{1-18}$ alkyl, C$_{2-18}$ alkenyl, —R*YR", —YR", and H;

each R" is independently selected from the group consisting of C$_{3-14}$ alkyl and C$_{3-14}$ alkenyl;

each R* is independently selected from the group consisting of C$_{1-12}$ alkyl and C$_{2-12}$ alkenyl;

each Y is independently a C$_{3-6}$ carbocycle;

each X is independently selected from the group consisting of F, Cl, Br, and I; and m is selected from 5, 6, 7, 8, 9, 10, 11, 12, and 13.

In some embodiments, a subset of compounds of Formula (I) includes those in which when R$_4$ is —(CH$_2$)$_n$Q, —(CH$_2$)$_n$CHQR, —CHQR, or —CQ(R)$_2$, then (i) Q is not —N(R)$_2$ when n is 1, 2, 3, 4 or 5, or (ii) Q is not 5, 6, or 7-membered heterocycloalkyl when n is 1 or 2.

In some embodiments, another subset of compounds of Formula (I) includes those in which R$_1$ is selected from the group consisting of C$_{5-30}$ alkyl, C$_{5-20}$ alkenyl, —R*YR", —YR", and —R"M'R';

R$_2$ and R$_3$ are independently selected from the group consisting of H, C$_{1-14}$ alkyl, C$_{2-14}$ alkenyl, —R*YR", —YR", and —R*OR", or R$_2$ and R$_3$, together with the atom to which they are attached, form a heterocycle or carbocycle;

R$_4$ is selected from the group consisting of a C$_{3-6}$ carbocycle, —(CH$_2$)$_n$Q, —(CH$_2$)$_n$CHQR, —CHQR, —CQ(R)$_2$, and unsubstituted C$_{1-6}$ alkyl, where Q is selected from a C$_{3-6}$ carbocycle, a 5- to 14-membered heteroaryl having one or more heteroatoms selected from N, O, and S, —OR, —O(CH$_2$)$_n$N(R)$_2$, —C(O)OR, —OC(O)R, —CX$_3$, —CX$_2$H, —CXH$_2$, —CN, —C(O)N(R)$_2$, —N(R)C(O)R, —N(R)S(O)$_2$R, —N(R)C(O)N(R)$_2$, —N(R)C(S)N(R)$_2$, —CRN(R)$_2$C(O)OR, —N(R)RR, —O(CH$_2$)$_n$OR, —N(R)C(=NR$_9$)N(R)$_2$, —N(R)C(=CHR$_9$)N(R)$_2$, —OC(O)N(R)$_2$, —N(R)C(O)OR, —N(OR)C(O)R, —N(OR)S(O)$_2$R, —N(OR)C(O)OR, —N(OR)C(O)N(R)$_2$, —N(OR)C(S)N(R)$_2$, —N(OR)C(=NR$_9$)N(R)$_2$, —N(OR)C(=CHR$_9$)N(R)$_2$, —C(=NR$_9$)N(R)$_2$, —C(=NR$_9$)R, —C(O)N(R)O R, and a 5- to 14-membered heterocycloalkyl having one or more heteroatoms selected from N, O, and S which is substituted with one or more substituents selected from oxo (=O), OH, amino, mono- or di-alkylamino, and C$_{1-3}$ alkyl, and each n is independently selected from 1, 2, 3, 4, and 5:

each R$_5$ is independently selected from the group consisting of C$_{1-3}$ alkyl, C$_{2-3}$ alkenyl, and H;

each R$_6$ is independently selected from the group consisting of C$_{1-3}$ alkyl, C$_{2-3}$ alkenyl, and H;

M and M' are independently selected from —C(O)O—, —OC(O)—, —C(O)N(R')—, —N(R')C(O)—, —C(O)—, —C(S)—, —C(S)S—, —SC(S)—, —CH(OH)—, —P(O)(OR')O—, —S(O)$_2$—, —S—S—, an aryl group, and a heteroaryl group:

R$_7$ is selected from the group consisting of C$_{1-3}$ alkyl, C$_{2-3}$ alkenyl, and H;

R$_8$ is selected from the group consisting of C$_{3-6}$ carbocycle and heterocycle:

R$_9$ is selected from the group consisting of H, CN, NO$_2$, C$_{1-6}$ alkyl, —OR, —S(O)$_2$R, —S(O)$_2$N(R)$_2$, C$_{2-6}$ alkenyl, C$_{3-6}$ carbocycle and heterocycle;

each R is independently selected from the group consisting of C$_{1-3}$ alkyl, C$_{2-3}$ alkenyl, and H;

each R' is independently selected from the group consisting of C$_{1-18}$ alkyl, C$_{2-18}$ alkenyl, —R*YR", —YR", and H;

each R" is independently selected from the group consisting of C$_{3-14}$ alkyl and C$_{3-14}$ alkenyl;

each R* is independently selected from the group consisting of C$_{1-12}$ alkyl and C$_{2-12}$ alkenyl;

each Y is independently a C$_{3-6}$ carbocycle;

each X is independently selected from the group consisting of F, Cl, Br, and I; and m is selected from 5, 6, 7, 8, 9, 10, 11, 12, and 13, or salts or isomers thereof.

In some embodiments, another subset of compounds of Formula (I) includes those in which R$_1$ is selected from the group consisting of C$_{5-30}$ alkyl, C$_{5-20}$ alkenyl, —R*YR", —YR", and —R"M'R';

R$_2$ and R$_3$ are independently selected from the group consisting of H, C$_{1-14}$ alkyl, C$_{2-14}$ alkenyl, —R*YR", —YR", and —R*OR", or R$_2$ and R$_3$, together with the atom to which they are attached, form a heterocycle or carbocycle:

R$_4$ is selected from the group consisting of a C$_{3-6}$ carbocycle, —(CH$_2$)$_n$Q, —(CH$_2$)$_n$CHQR, —CHQR, —CQ(R)$_2$, and unsubstituted C$_{1-6}$ alkyl, where Q is selected from a C$_{3-6}$ carbocycle, a 5- to 14-membered heterocycle having one or more heteroatoms selected from N, O, and S, —OR, —O(CH$_2$)$_n$N(R)$_2$, —C(O)OR, —OC(O)R, —CX$_3$, —CX$_2$H, —CXH$_2$, —CN, —C(O)N(R)$_2$, —N(R)C(O)R, —N(R)S(O)$_2$R, —N(R)C(O)N(R)$_2$, —N(R)C(S)N(R)$_2$, —CRN(R)$_2$C(O)OR, —N(R)R$_8$, —O(CH$_2$)$_n$OR, —N(R)C(=NR$_9$)N(R)$_2$, —N(R)C(=CHR$_9$)N(R)$_2$, —OC(O)N(R)$_2$, —N(R)C(O)OR, —N(OR)C(O)R, —N(OR)S(O)$_2$R, —N(OR)C(O)OR, —N(OR)C(O)N(R)$_2$, —N(OR)C(S)N(R)$_2$, —N(OR)C(=NR$_9$)N(R)$_2$, —N(OR)C(=CHR$_9$)N(R)$_2$, —C(=NR$_9$)R, —C(O)N(R)OR, and —C(=NR$_9$)N(R)$_2$, and each n is independently selected from 1, 2, 3, 4, and 5; and when Q is a 5- to 14-membered heterocycle and (i) R$_4$ is —(CH$_2$)$_n$Q in which n is 1 or 2, or (ii) R$_4$ is —(CH$_2$)$_n$CHQR in which n is 1, or (iii) R$_4$ is —CHQR, and —CQ(R)$_2$, then Q is either a 5- to 14-membered heteroaryl or 8- to 14-membered heterocycloalkyl;

each R$_5$ is independently selected from the group consisting of C$_{1-3}$ alkyl, C$_{2-3}$ alkenyl, and H;

each R$_6$ is independently selected from the group consisting of C$_{1-3}$ alkyl, C$_{2-3}$ alkenyl, and H;

M and M' are independently selected from —C(O)O—, —OC(O)—, —C(O)N(R')—, —N(R')C(O)—, —C(O)—, —C(S)—, —C(S)S—, —SC(S)—, —CH(OH)—, —P(O)(OR')O—, —S(O)$_2$—, —S—S—, an aryl group, and a heteroaryl group:

R$_7$ is selected from the group consisting of C$_{1-3}$ alkyl, C$_{2-3}$ alkenyl, and H;

$R_8$ is selected from the group consisting of $C_{3-6}$ carbocycle and heterocycle;

$R_9$ is selected from the group consisting of H, CN, NO$_2$, $C_{1-6}$ alkyl, —OR, —S(O)$_2$R, —S(O)$_2$N(R)$_2$, $C_{2-6}$ alkenyl, $C_{3-6}$ carbocycle and heterocycle:

each R is independently selected from the group consisting of $C_{1-3}$ alkyl, $C_{2-3}$ alkenyl, and H;

each R' is independently selected from the group consisting of $C_{1-18}$ alkyl, $C_{2-18}$ alkenyl, —R*YR", —YR", and H;

each R" is independently selected from the group consisting of $C_{3-14}$ alkyl and $C_{3-14}$ alkenyl;

each R* is independently selected from the group consisting of $C_{1-12}$ alkyl and $C_{2-12}$ alkenyl;

each Y is independently a C3.6 carbocycle:

each X is independently selected from the group consisting of F, Cl, Br, and I; and m is selected from 5, 6, 7, 8, 9, 10, 11, 12, and 13, or salts or isomers thereof.

In some embodiments, another subset of compounds of Formula (I) includes those in which $R_1$ is selected from the group consisting of $C_{5-30}$ alkyl, $C_{5-20}$ alkenyl, —R*YR", —YR", and —R"'M'R';

$R_2$ and $R_3$ are independently selected from the group consisting of H, $C_{1-14}$ alkyl, $C_{2-14}$ alkenyl, —R*YR", —YR", and —R*OR", or $R_2$ and $R_3$, together with the atom to which they are attached, form a heterocycle or carbocycle:

$R_4$ is selected from the group consisting of a $C_{3-6}$ carbocycle, —(CH$_2$)$_n$Q, —(CH$_2$)$_n$CHQR, —CHQR, —CQ(R)$_2$, and unsubstituted $C_{1-6}$ alkyl, where Q is selected from a $C_{3-6}$ carbocycle, a 5- to 14-membered heteroaryl having one or more heteroatoms selected from N, O, and S, —OR, —O(CH$_2$)$_n$N(R)$_2$, —C(O)OR, —OC(O)R, —CX$_3$, —CX$_2$H, —CXH$_2$, —CN, —C(O)N(R)$_2$. —N(R)C(O)R, —N(R)S(O)$_2$R, —N(R)C(O)N(R)$_2$, —N(R)C(S)N(R)$_2$, —CRN(R)$_2$C(O)OR, —N(R)R$_8$, —O(CH$_2$)$_n$OR, —N(R)C(=NR$_9$)N(R)$_2$, —N(R)C(=CHR$_9$)N(R)$_2$, —OC(O)N(R)$_2$, —N(R)C(O)OR, —N(OR)C(O)R, —N(OR)S(O)$_2$R, —N(OR)C(O)OR, —N(OR)C(O)N(R)$_2$, —N(OR)C(S)N(R)$_2$, —N(OR)C(=NR$_9$)N(R)$_2$, —N(OR)C(=CHR$_9$)N(R)$_2$, —C(=NR$_9$)R, —C(O)N(R)OR, and —C(=NR$_9$)N(R)$_2$, and each n is independently selected from 1, 2, 3, 4, and 5;

each $R_5$ is independently selected from the group consisting of $C_{1-3}$ alkyl, $C_{2-3}$ alkenyl, and H;

each $R_6$ is independently selected from the group consisting of $C_{1-3}$ alkyl, $C_{2-3}$ alkenyl, and H;

M and M' are independently selected from —C(O)O—, —OC(O)—, —C(O)N(R')—, —N(R')C(O)—, —C(O)—, —C(S)—, —C(S)S—, —SC(S)—, —CH(OH)—, —P(O)(OR')O—, —S(O)$_2$—, —S—S—, an aryl group, and a heteroaryl group:

$R_7$ is selected from the group consisting of $C_{1-3}$ alkyl, $C_{2-3}$ alkenyl, and H:

$R_8$ is selected from the group consisting of $C_{3-6}$ carbocycle and heterocycle;

$R_9$ is selected from the group consisting of H, CN, NO$_2$, $C_{1-6}$ alkyl, —OR, —S(O)$_2$R, —S(O)$_2$N(R)$_2$, $C_{2-6}$ alkenyl, $C_{3-6}$ carbocycle and heterocycle:

each R is independently selected from the group consisting of $C_{1-3}$ alkyl, $C_{2-3}$ alkenyl, and H;

each R' is independently selected from the group consisting of $C_{1-18}$ alkyl, $C_{2-18}$ alkenyl, —R*YR", —YR", and H;

each R" is independently selected from the group consisting of $C_{3-14}$ alkyl and $C_{3-14}$ alkenyl;

each R* is independently selected from the group consisting of $C_{1-12}$ alkyl and $C_{2-12}$ alkenyl;

each Y is independently a $C_{3-6}$ carbocycle;

each X is independently selected from the group consisting of F, Cl, Br, and I; and m is selected from 5, 6, 7, 8, 9, 10, 11, 12, and 13, or salts or isomers thereof.

In some embodiments, another subset of compounds of Formula (I) includes those in which $R_1$ is selected from the group consisting of $C_{5-30}$ alkyl, $C_{5-20}$ alkenyl, —R*YR", —YR", and —R"'M'R':

$R_2$ and $R_3$ are independently selected from the group consisting of H, $C_{2-14}$ alkyl, $C_{2-14}$ alkenyl, —R*YR", —YR", and —R*OR", or $R_2$ and $R_3$, together with the atom to which they are attached, form a heterocycle or carbocycle:

$R_4$ is —(CH$_2$)$_n$Q or —(CH$_2$)$_n$CHQR, where Q is —N(R)$_2$, and n is selected from 3, 4, and 5:

each $R_5$ is independently selected from the group consisting of $C_{1-3}$ alkyl, $C_{2-3}$ alkenyl, and H;

each $R_6$ is independently selected from the group consisting of $C_{1-3}$ alkyl, $C_{2-3}$ alkenyl, and H.

M and M' are independently selected from —C(O)O—, —OC(O)—, —C(O)N(R')—, —N(R')C(O)—, —C(O)—, —C(S)—, —C(S)S—, —SC(S)—, —CH(OH)—, —P(O)(OR')O—, —S(O)$_2$—, —S—S—, an aryl group, and a heteroaryl group;

$R_7$ is selected from the group consisting of $C_{1-3}$ alkyl, $C_{2-3}$ alkenyl, and H:

each R is independently selected from the group consisting of $C_{1-3}$ alkyl, $C_{2-3}$ alkenyl, and H:

each R' is independently selected from the group consisting of $C_{1-18}$ is alkyl, $C_{2-18}$ alkenyl, —R*YR", —YR", and H;

each R" is independently selected from the group consisting of $C_{3-14}$ alkyl and $C_{3-14}$ alkenyl;

each R* is independently selected from the group consisting of $C_{1-12}$ alkyl and $C_{1-12}$ alkenyl;

each Y is independently a $C_{3-6}$ carbocycle;

each X is independently selected from the group consisting of F, Cl, Br, and I; and m is selected from 5, 6, 7, 8, 9, 10, 11, 12, and 13, or salts or isomers thereof.

In some embodiments, another subset of compounds of Formula (I) includes those in which $R_1$ is selected from the group consisting of $C_{5-30}$ alkyl, $C_{5-20}$ alkenyl, —R*YR", —YR", and —R"'M'R":

$R_2$ and $R_3$ are independently selected from the group consisting of $C_{1-14}$ alkyl, $C_{2-14}$ alkenyl, —R*YR", —YR", and —R*OR", or $R_2$ and $R_3$, together with the atom to which they are attached, form a heterocycle or carbocycle;

$R_4$ is selected from the group consisting of —(CH$_2$)$_n$Q, —(CH$_2$)$_n$CHQR, —CHQR, and —CQ(R)$_2$, where Q is —N(R)$_2$, and n is selected from 1, 2, 3, 4, and 5:

each $R_5$ is independently selected from the group consisting of $C_{1-3}$ alkyl, $C_{2-3}$ alkenyl, and H;

each $R_6$ is independently selected from the group consisting of $C_{1-3}$ alkyl, $C_{2-3}$ alkenyl, and H;

M and M' are independently selected from —C(O)O—, —OC(O)—, —C(O)N(R')—, —N(R')C(O)—, —C(O)—, —C(S)—, —C(S)S—, —SC(S)—, —CH(OH)—, —P(O)(OR')O—, —S(O)$_2$—, —S—S—, an aryl group, and a heteroaryl group:

$R_7$ is selected from the group consisting of $C_{1-3}$ alkyl, $C_{2-3}$ alkenyl, and H;

each R is independently selected from the group consisting of $C_{1-3}$ alkyl, $C_{2-3}$ alkenyl, and H;

each R' is independently selected from the group consisting of $C_{1-18}$ alkyl, $C_{2-18}$ alkenyl, —R*YR", —YR", and H:

each R" is independently selected from the group consisting of $C_{3-14}$ alkyl and $C_{3-14}$ alkenyl;

each R* is independently selected from the group consisting of $C_{1-12}$ alkyl and $C_{1-12}$ alkenyl;

each Y is independently a $C_{3-6}$ carbocycle:

each X is independently selected from the group consisting of F, Cl, Br, and I; and m is selected from 5, 6, 7, 8, 9, 10, 11, 12, and 13, or salts or isomers thereof.

In some embodiments, a subset of compounds of Formula (I) includes those of Formula (IA):

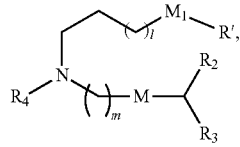

(IA)

or a salt or isomer thereof, wherein l is selected from 1, 2, 3, 4, and 5; m is selected from 5, 6, 7, 8, and 9; $M_1$ is a bond or M'; $R_4$ is unsubstituted $C_{1-3}$ alkyl, or —$(CH_2)_nQ$, in which Q is OH, —NHC(S)N(R)$_2$, —NHC(O)N(R)$_2$, —N(R)C(O)R, —N(R)S(O)$_2$R, —N(R)R. —NHC(=NR$_9$)N(R)$_2$, —NHC(=CHR$_9$)N(R)$_2$, —OC(O)N(R)$_2$, —N(R)C(O)OR, heteroaryl or heterocycloalkyl; M and M' are independently selected from —C(O)O—, —OC(O)—, —C(O)N(R')—, —P(O)(OR')O—, —S—S—, an aryl group, and a heteroaryl group; and $R_2$ and $R_3$ are independently selected from the group consisting of H, $C_{1-14}$ alkyl, and $C_{2-14}$ alkenyl.

In some embodiments, a subset of compounds of Formula (I) includes those of Formula (II):

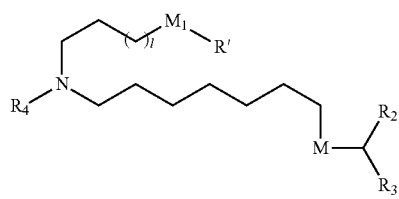

(II)

or a salt or isomer thereof, wherein l is selected from 1, 2, 3, 4, and 5; $M_1$ is a bond or M'; $R_4$ is unsubstituted $C_{1-3}$ alkyl, or —$(CH_2)_nQ$, in which n is 2, 3, or 4, and Q is OH, —NHC(S)N(R)$_2$, —NHC(O)N(R)?, —N(R)C(O)R, —N(R)S(O)$_2$R, —N(R)R$_8$, —NHC(=NR$_9$)N(R)$_2$, —NHC(=CHR$_9$)N(R)$_2$, —OC(O)N(R)$_2$, —N(R)C(O)OR, heteroaryl or heterocycloalkyl; M and M' are independently selected from —C(O)O—, —OC(O)—, —C(O)N(R')—, —P(O)(OR')O—, —S—S—, an aryl group, and a heteroaryl group; and $R_2$ and $R_3$ are independently selected from the group consisting of H, $C_{1-14}$ alkyl, and $C_{2-14}$ alkenyl.

In some embodiments, a subset of compounds of Formula (I) includes those of Formula (IIa), (IIb), (IIc), or (IIe):

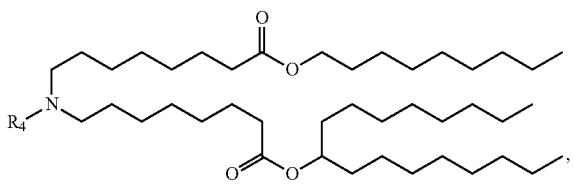

(IIa)

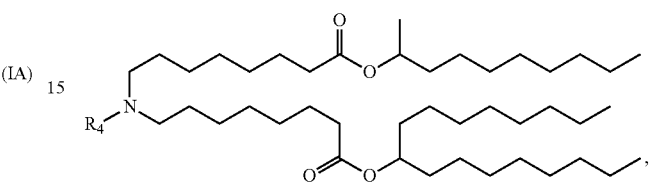

(IIb)

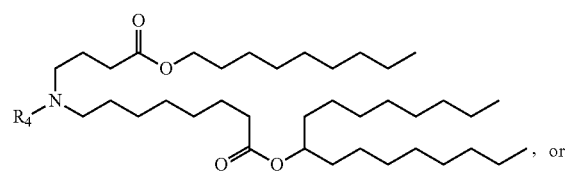

(IIc)

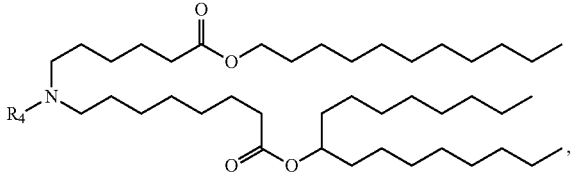

(IIe)

or a salt or isomer thereof, wherein $R_4$ is as described herein.

In some embodiments, a subset of compounds of Formula (I) includes those of Formula (IId):

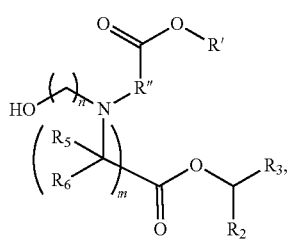

(IId)

or a salt or isomer thereof, wherein n is 2, 3, or 4; and m, R', R", and $R_2$ through $R_6$ are as described herein. For example, each of $R_2$ and $R_3$ may be independently selected from the group consisting of $C_{5-14}$ alkyl and $C_{5-14}$ alkenyl.

In some embodiments, the compound of Formula (I) is selected from the group consisting of:

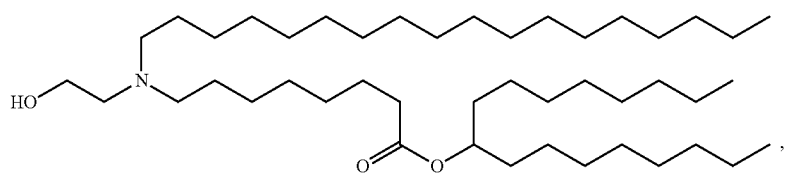
(Compound 1)
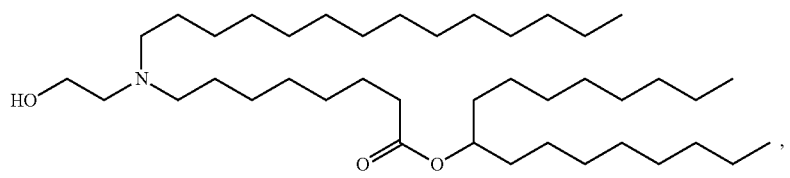
(Compound 2)
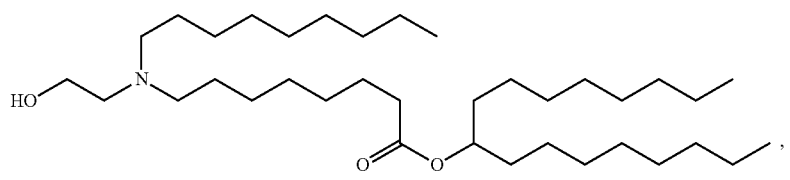
(Compound 3)
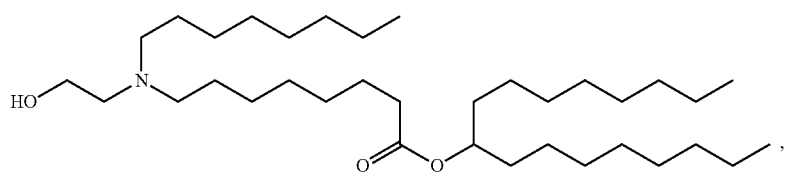
(Compound 4)
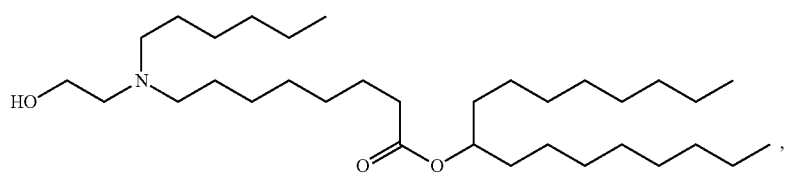
(Compound 5)
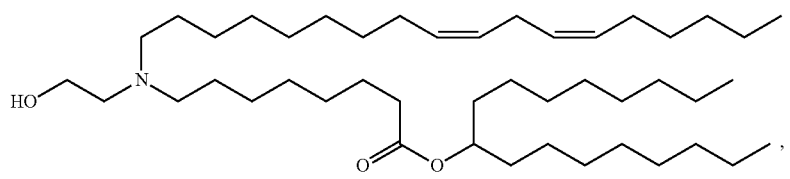
(Compound 6)
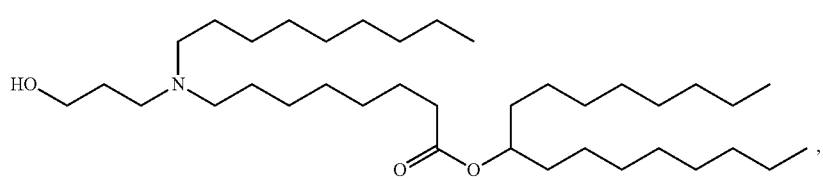
(Compound 7)
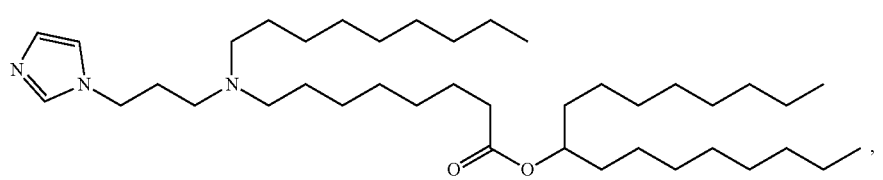
(Compound 8)
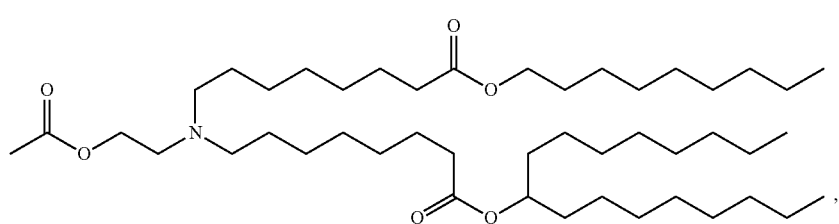
(Compound 9)

(Compound 10)
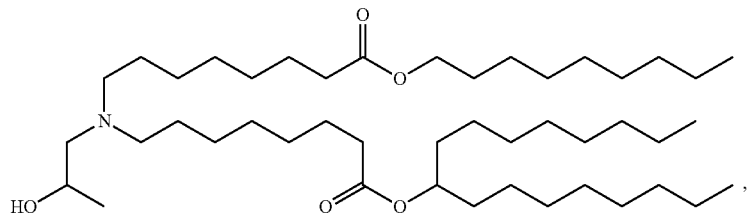
(Compound 11)
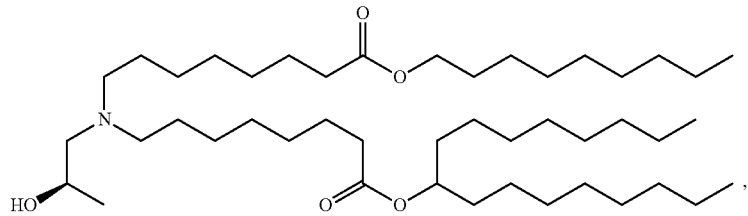
(Compound 12)
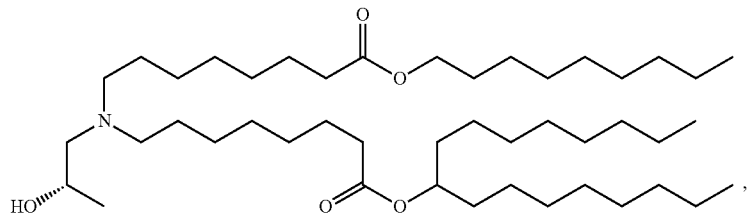
(Compound 13)
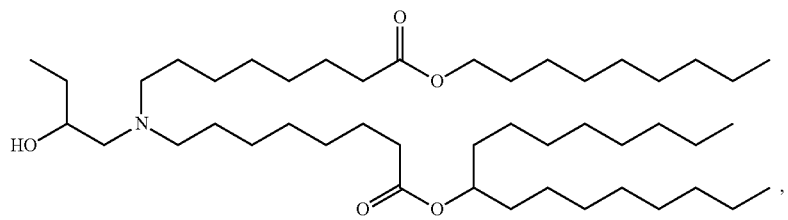
(Compound 14)
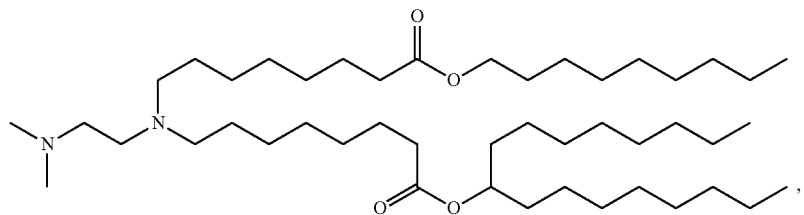
(Compound 15)
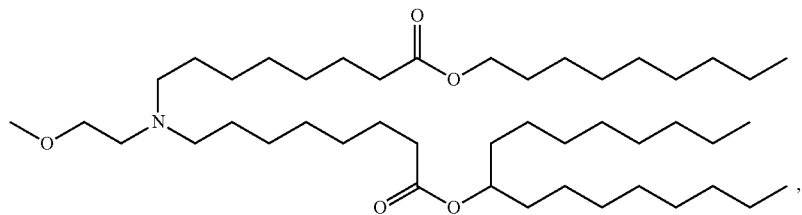
(Compound 16)
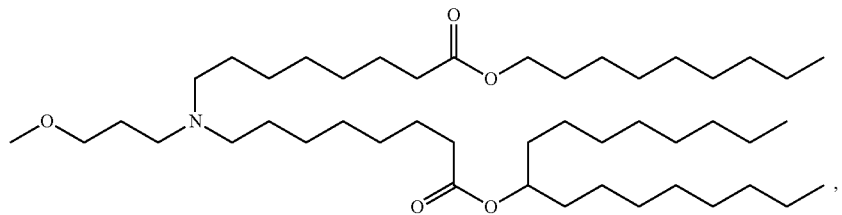

-continued
(Compound 17)
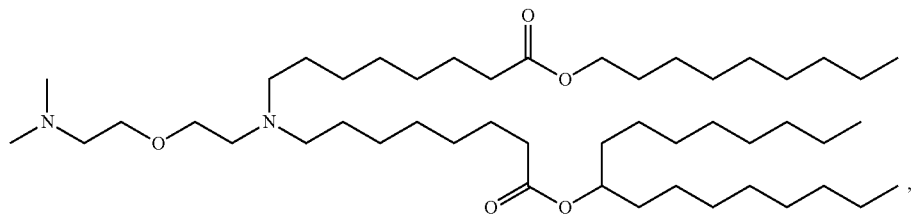
(Compound 18)
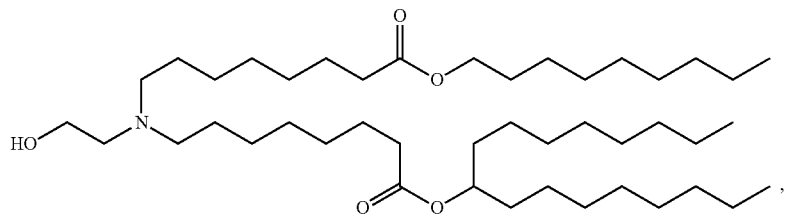
(Compound 19)
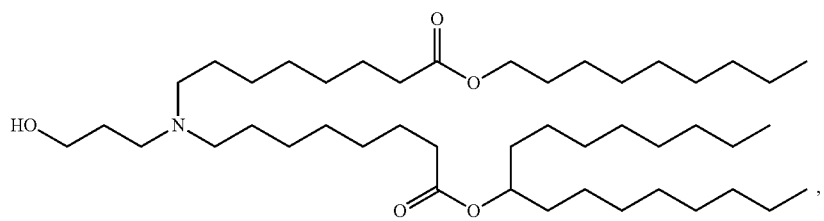
(Compound 20)
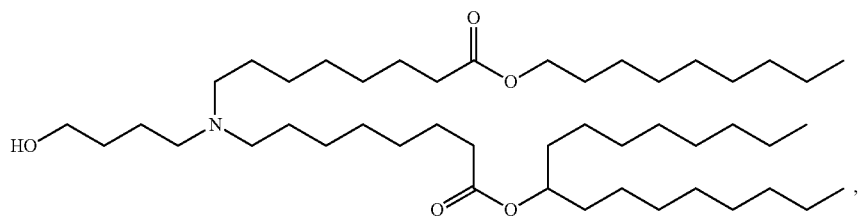
(Compound 21)
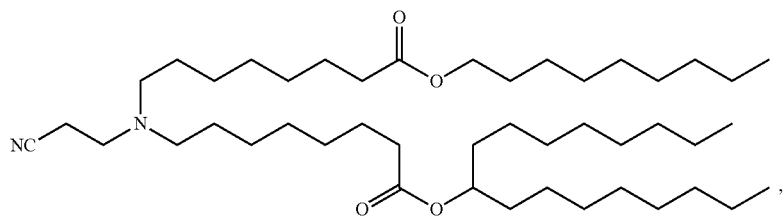
(Compound 22)
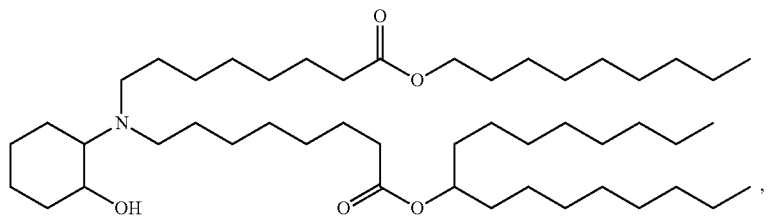
(Compound 23)
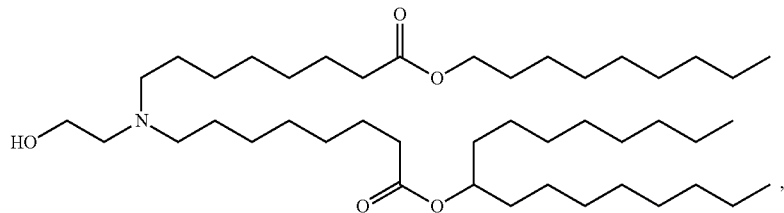

-continued
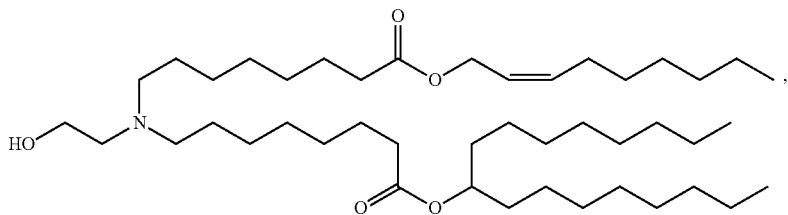
(Compound 24)
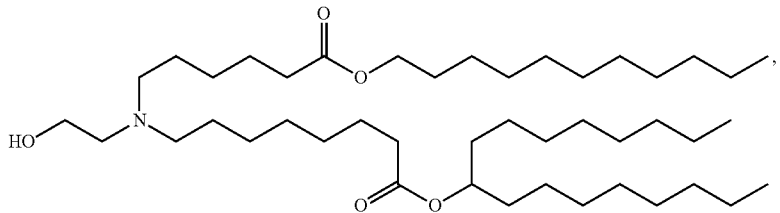
(Compound 25)
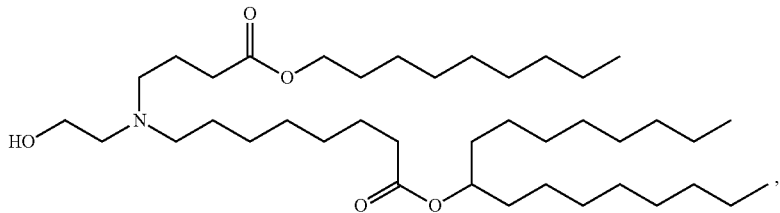
(Compound 26)
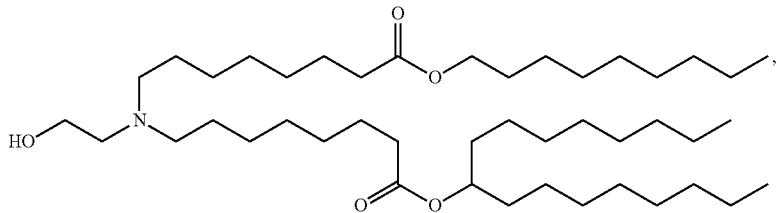
(Compound 27)
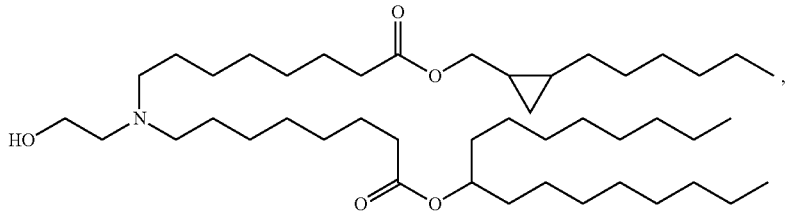
(Compound 28)
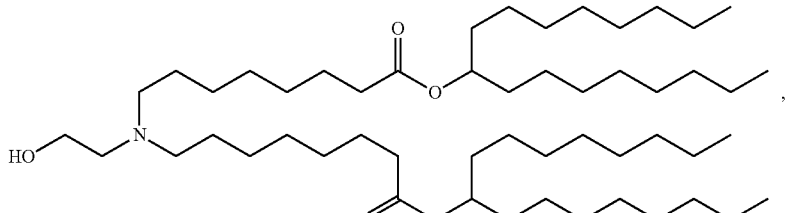
(Compound 29)
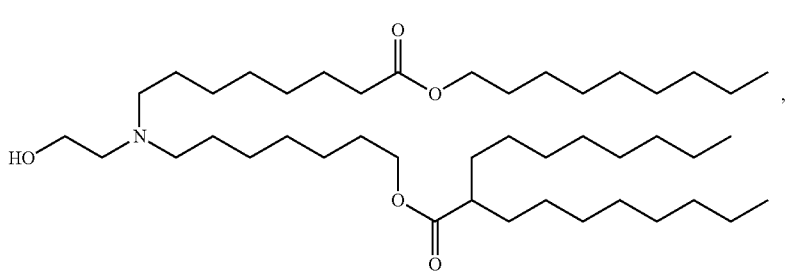
(Compound 30)

-continued
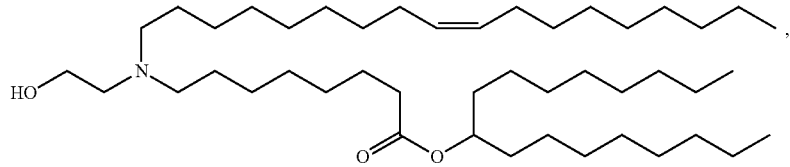
(Compound 31)
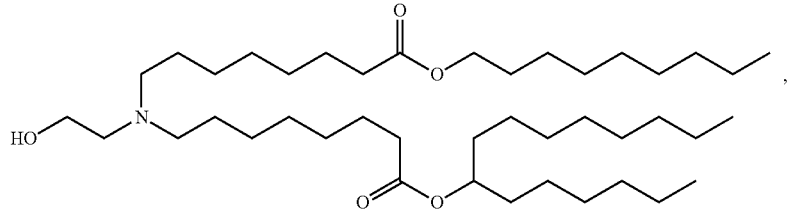
(Compound 32)
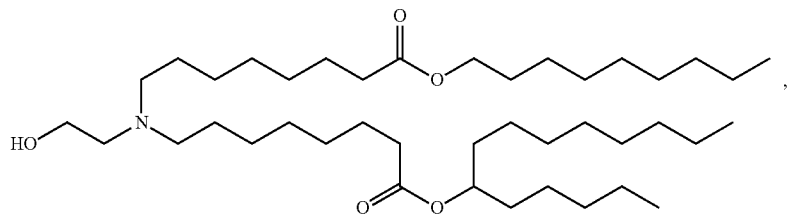
(Compound 33)
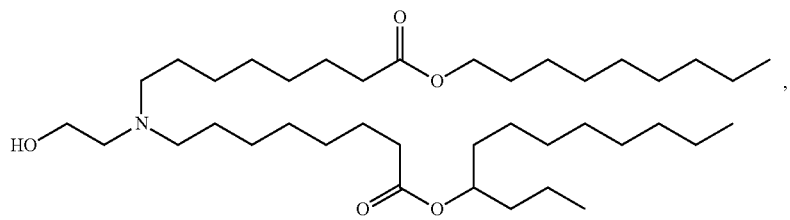
(Compound 34)
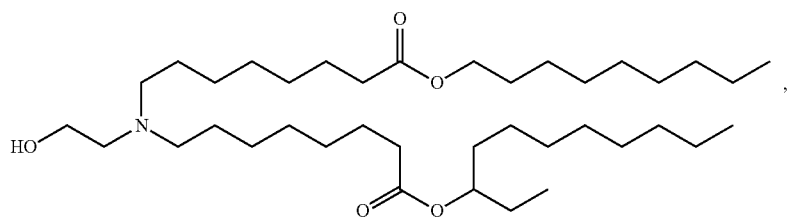
(Compound 35)
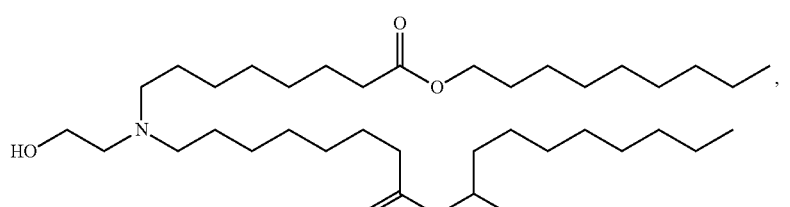
(Compound 36)
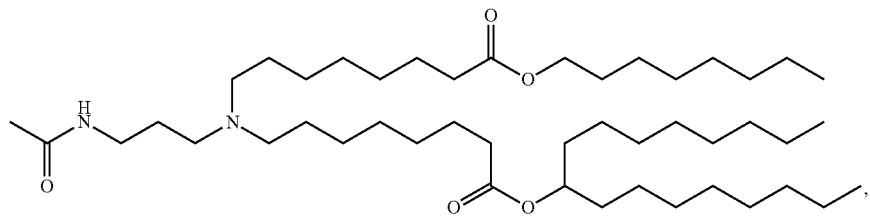
(Compound 37)

-continued
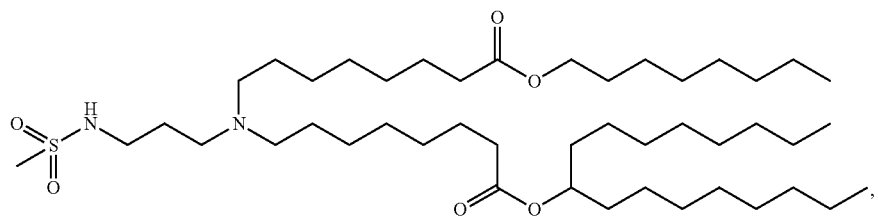
(Compound 38)
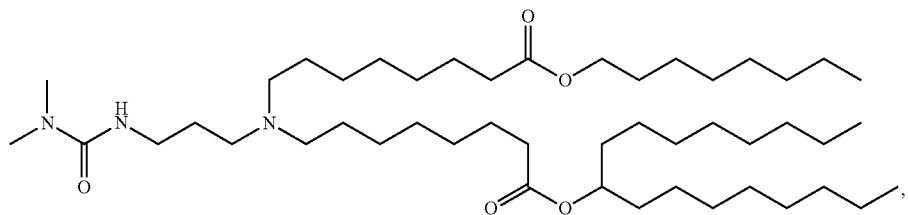
(Compound 39)
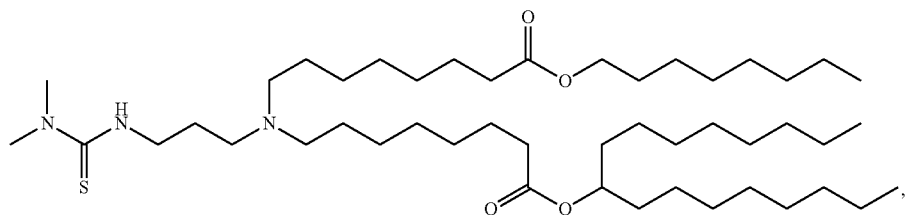
(Compound 40)
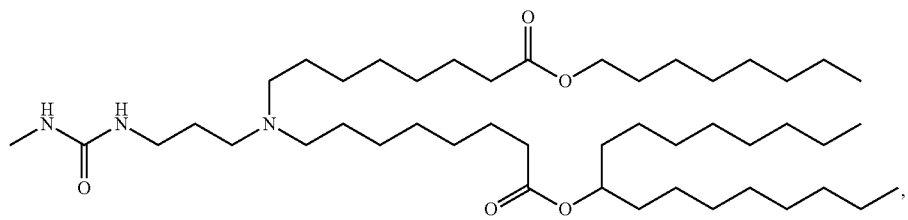
(Compound 41)
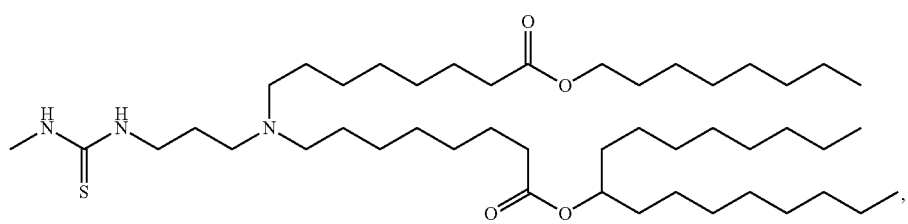
(Compound 42)
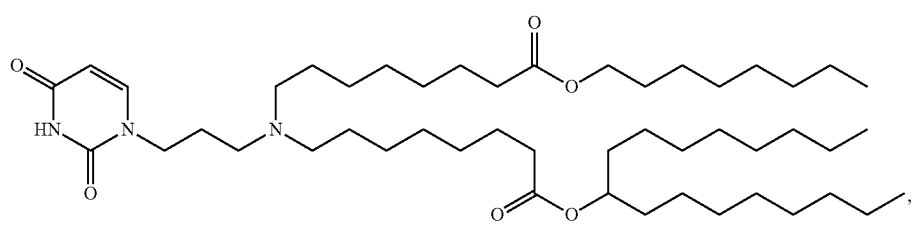
(Compound 43)
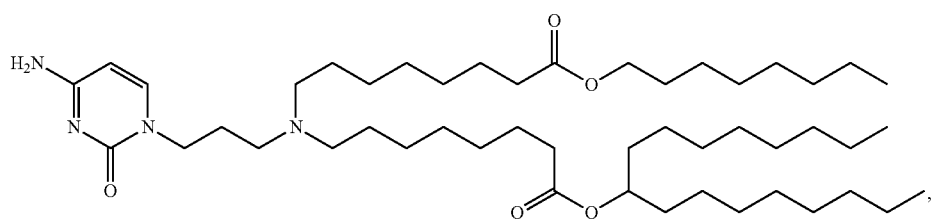
(Compound 44)

(Compound 45)
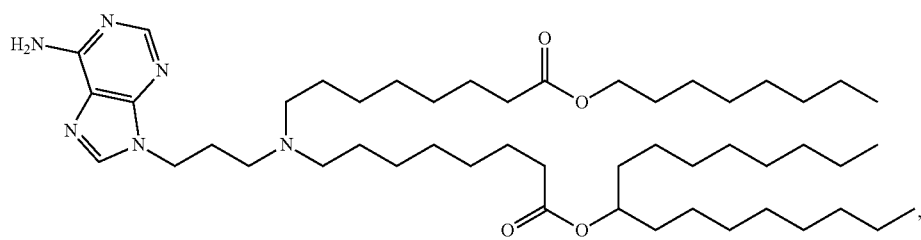
(Compound 46)
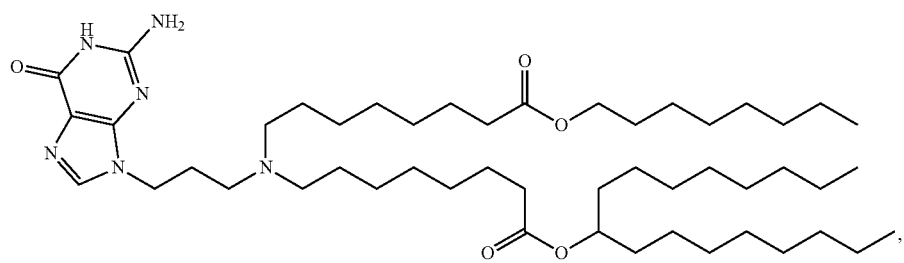
(Compound 47)
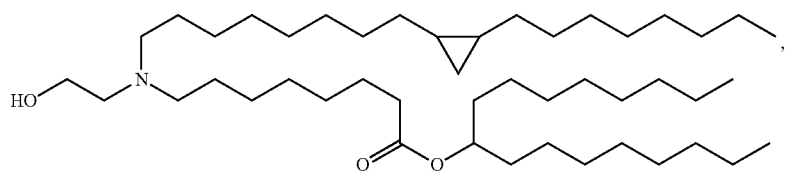
(Compound 48)
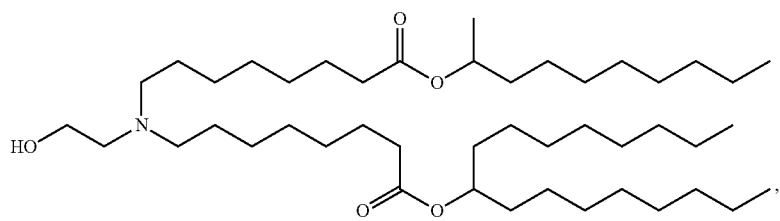
(Compound 49)
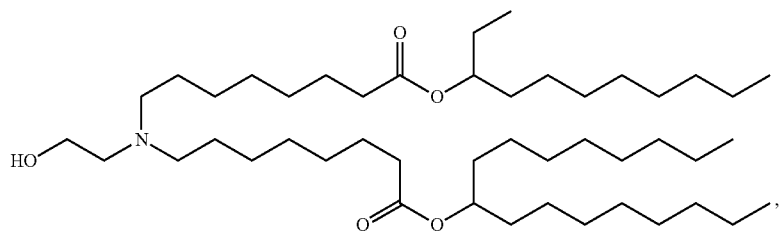
(Compound 50)
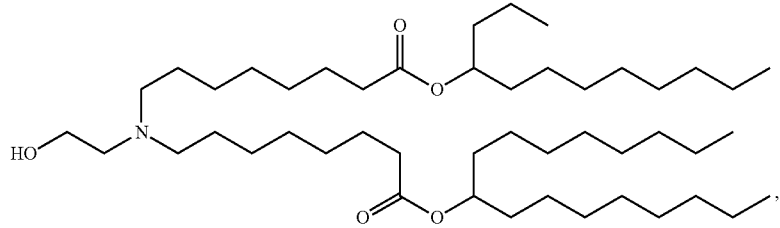
(Compound 51)
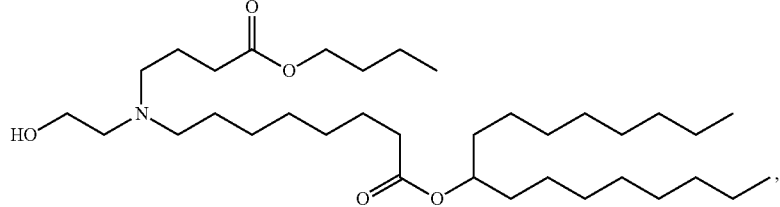

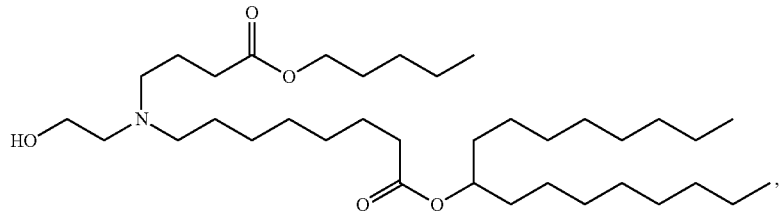
(Compound 52)
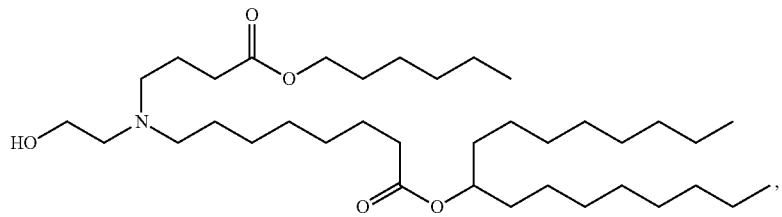
(Compound 53)
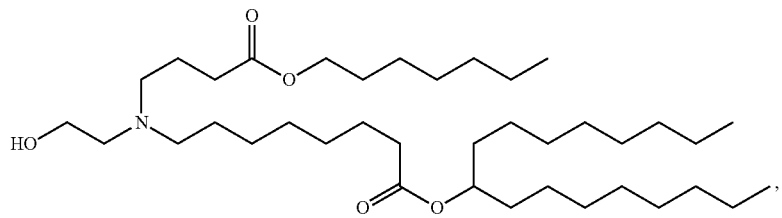
(Compound 54)
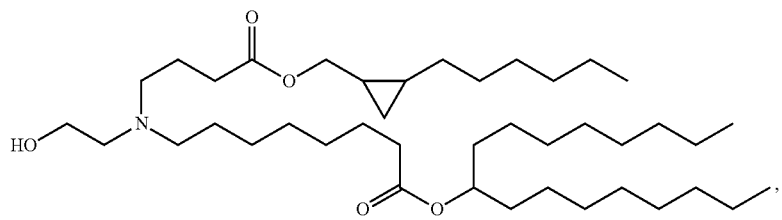
(Compound 55)
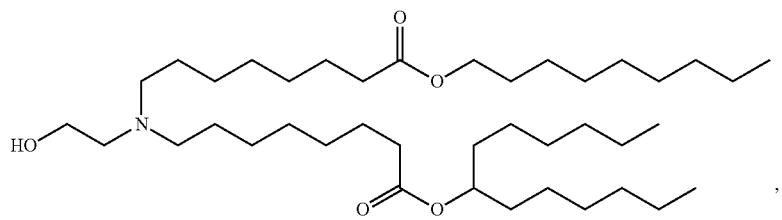
(Compound 56)
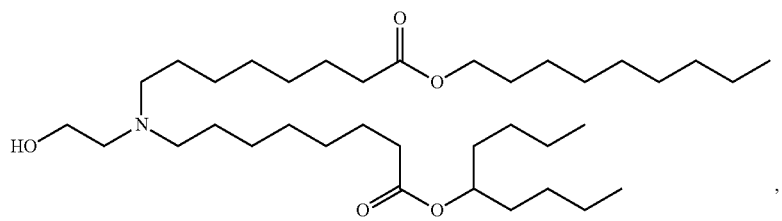
(Compound 57)
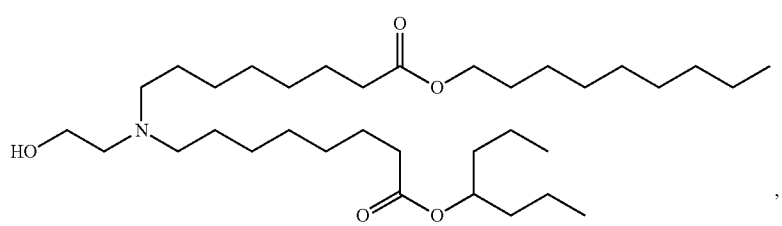
(Compound 58)

(Compound 59)
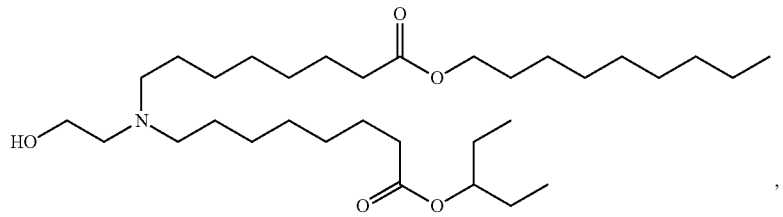
,
(Compound 60)
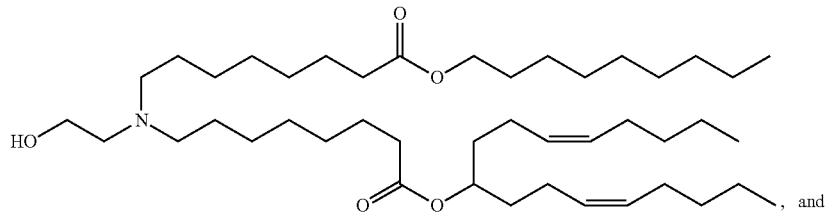
, and
(Compound 61)
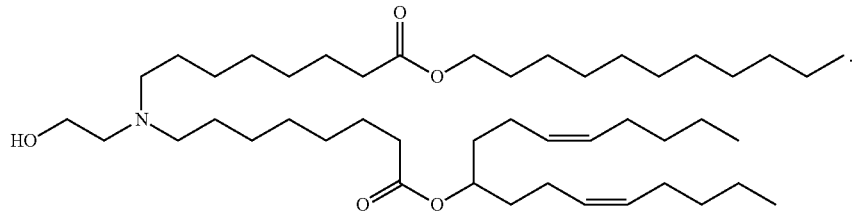
.
In further embodiments, the compound of Formula (I) is selected from the group consisting of
(Compound 62)
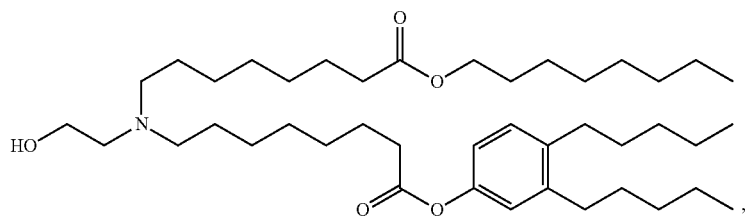
,
(Compound 63)
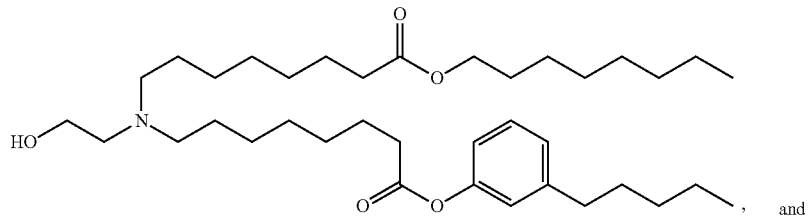
, and
(Compound 64)
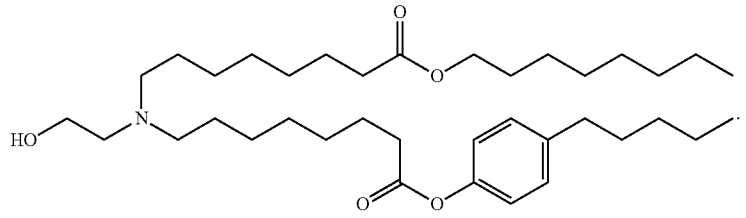
.

In some embodiments, the compound of Formula (I) is selected from the group consisting of:
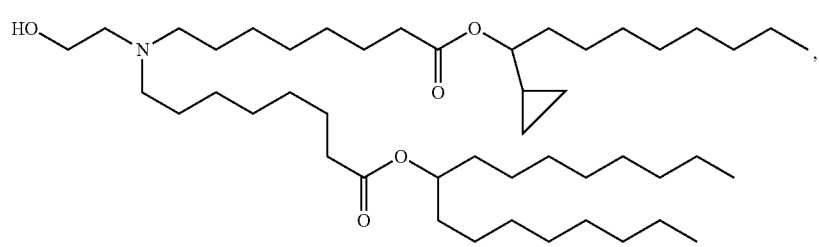
(Compound 65)
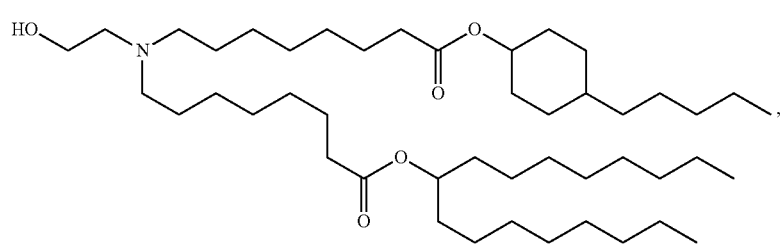
(Compound 66)
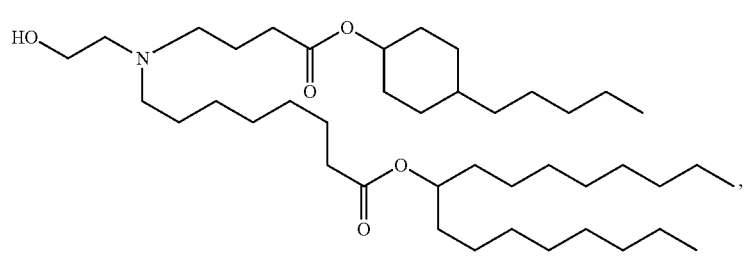
(Compound 67)
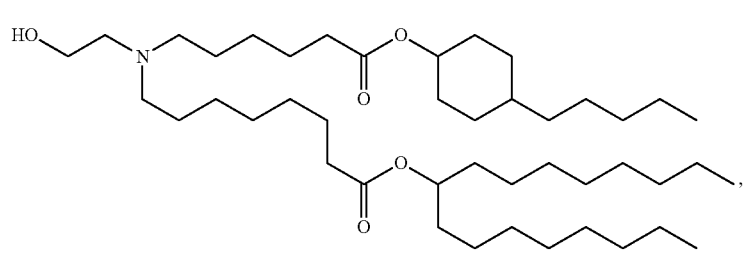
(Compound 68)
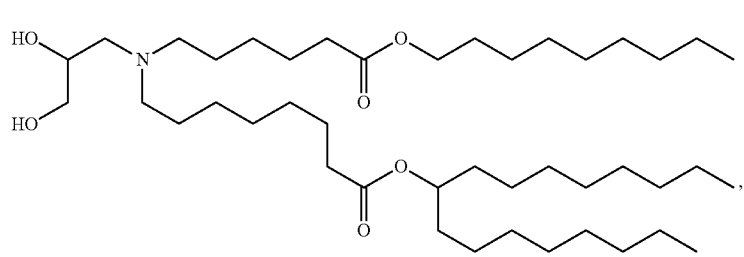
(Compound 69)
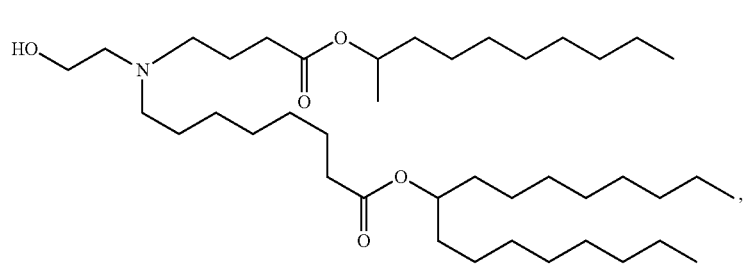
(Compound 70)

-continued
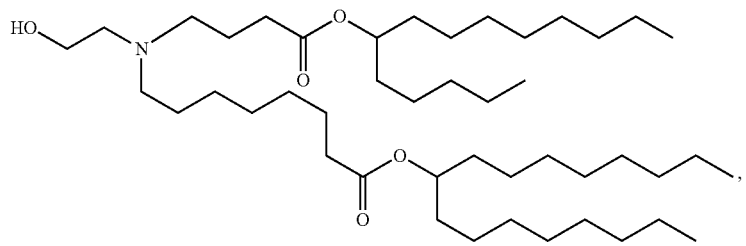
(Compound 71)
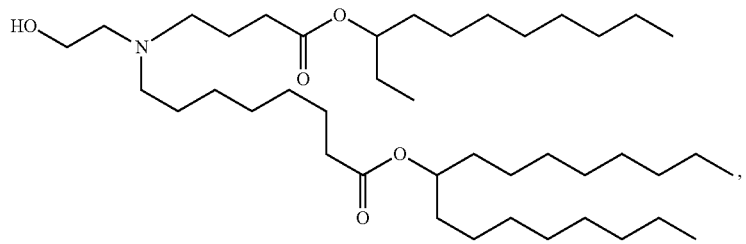
(Compound 72)
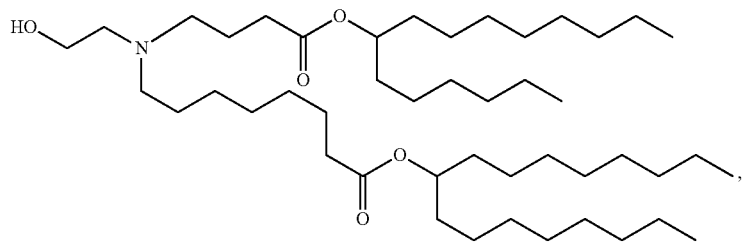
(Compound 73)
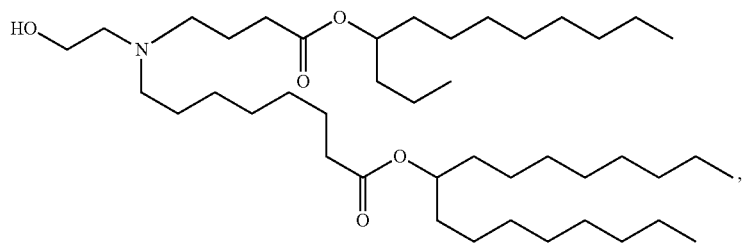
(Compound 74)
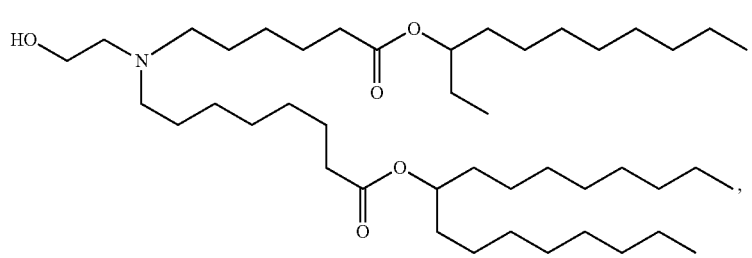
(Compound 75)
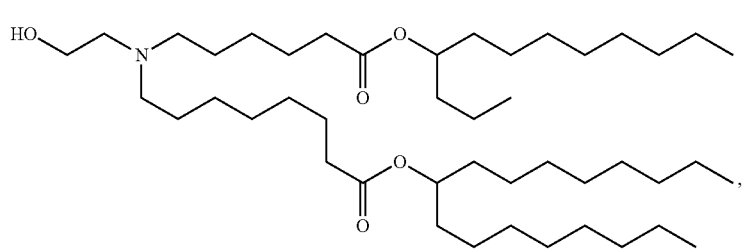
(Compound 76)

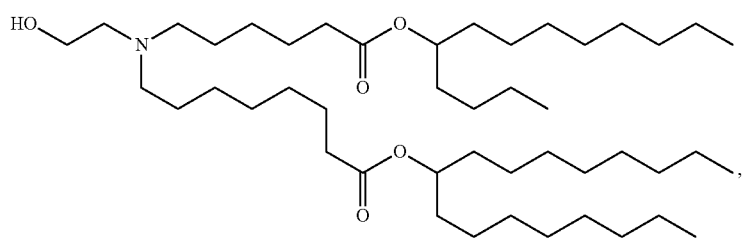
(Compound 77)
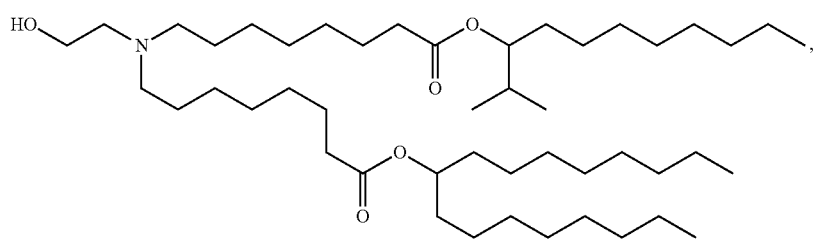
(Compound 78)
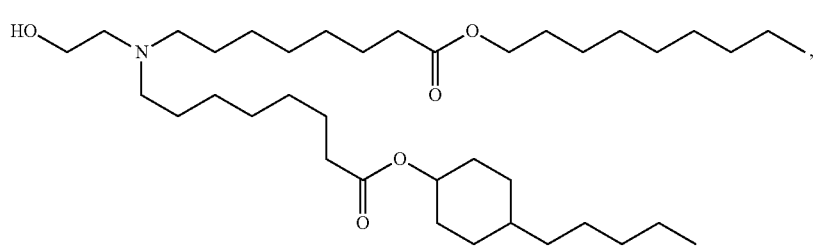
(Compound 79)
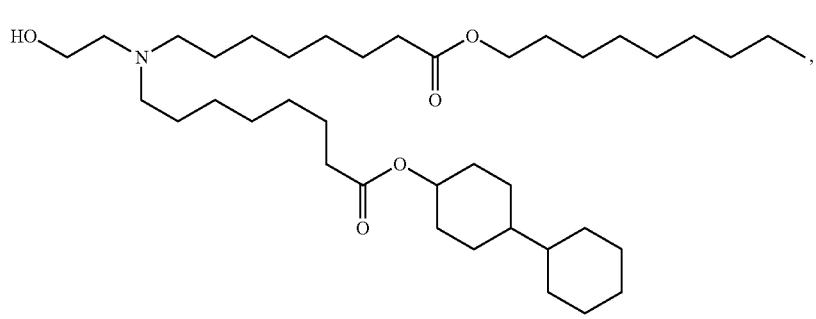
(Compound 80)
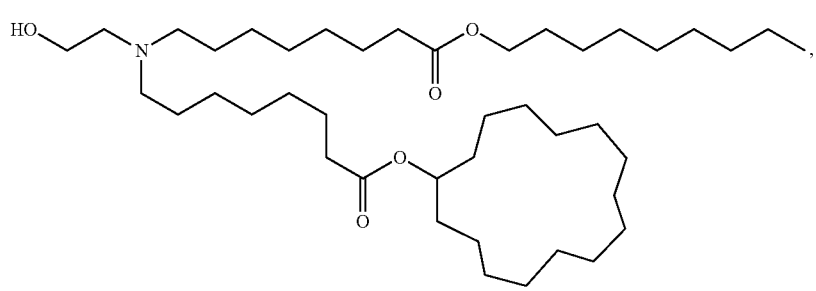
(Compound 81)
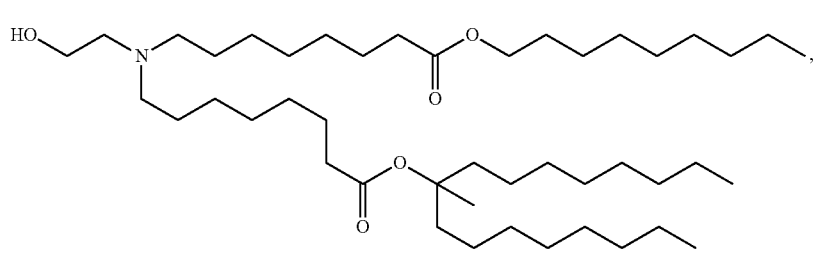
(Compound 82)

-continued
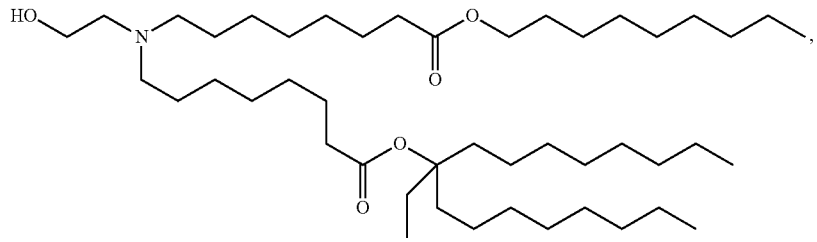
(Compound 83)
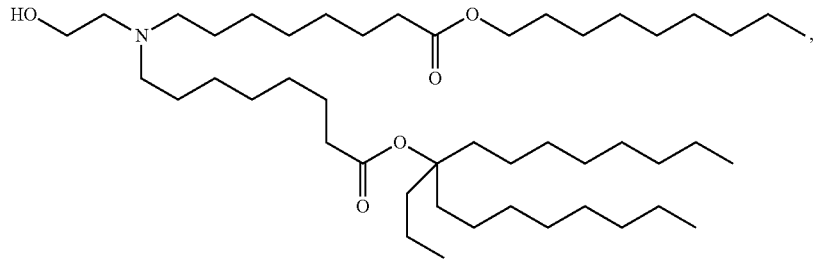
(Compound 84)
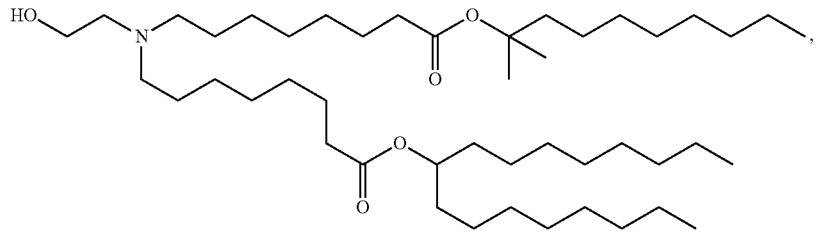
(Compound 85)
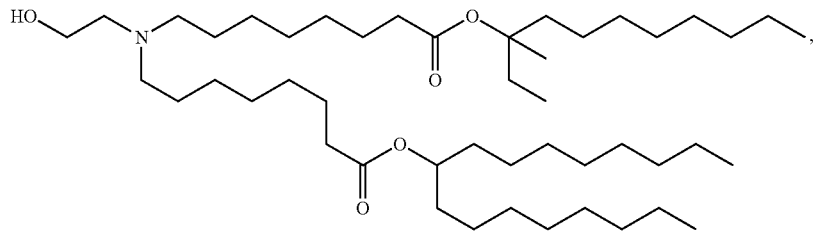
(Compound 86)
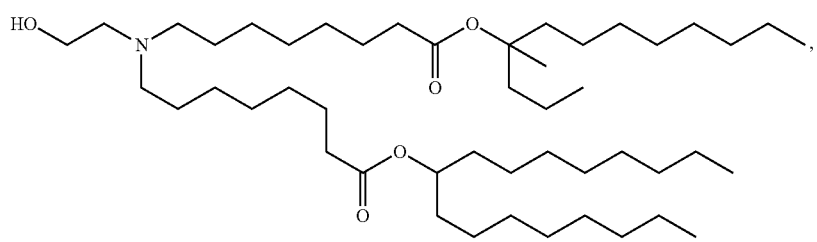
(Compound 87)
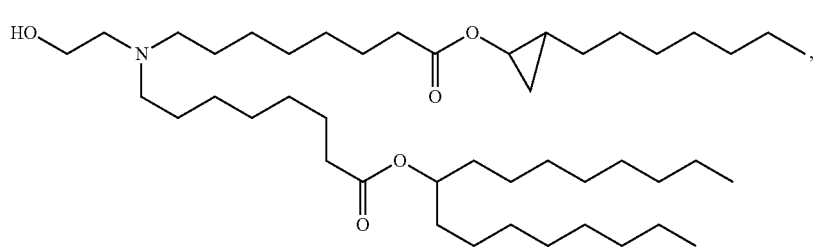
(Compound 88)

-continued
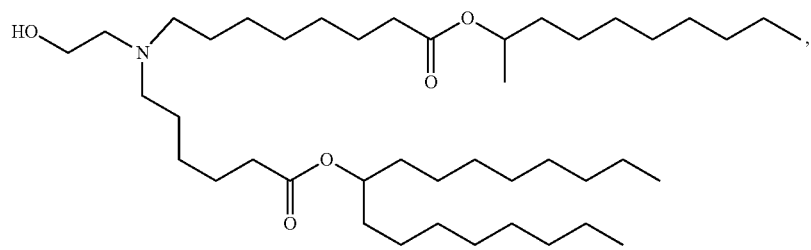
(Compound 89)
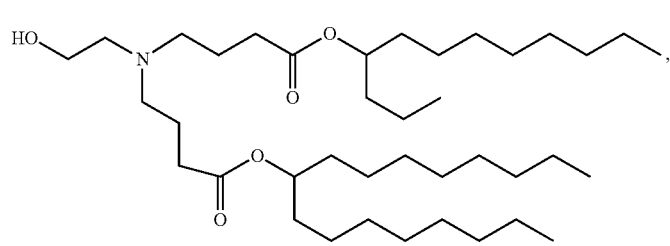
(Compound 90)
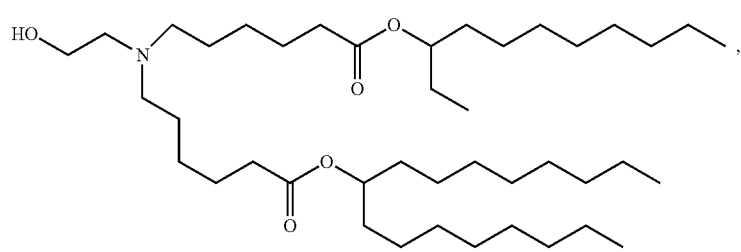
(Compound 91)
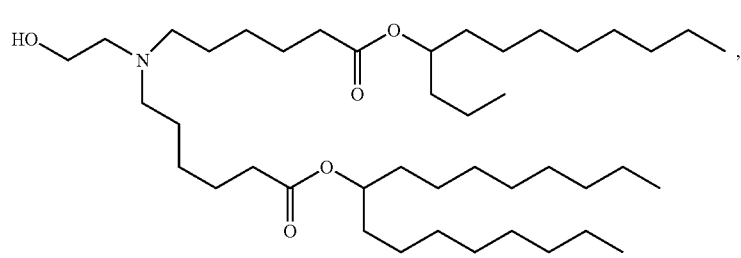
(Compound 92)
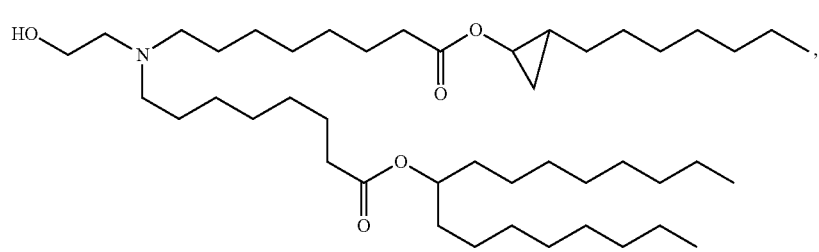
(Compound 93)
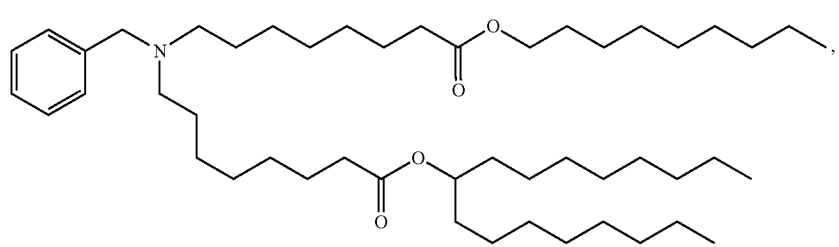
(Compound 94)

-continued
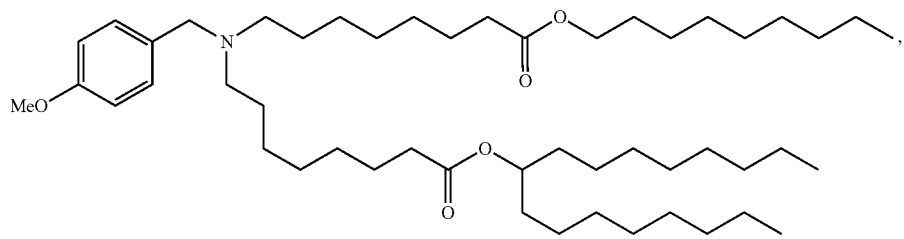
(Compound 95)
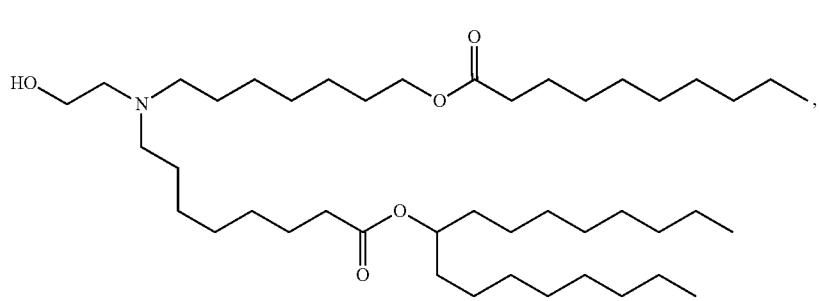
(Compound 96)
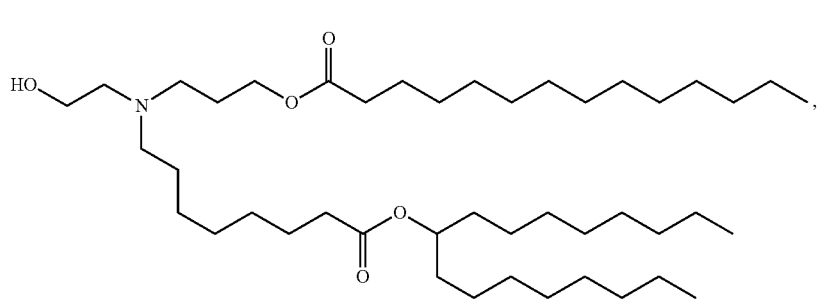
(Compound 97)
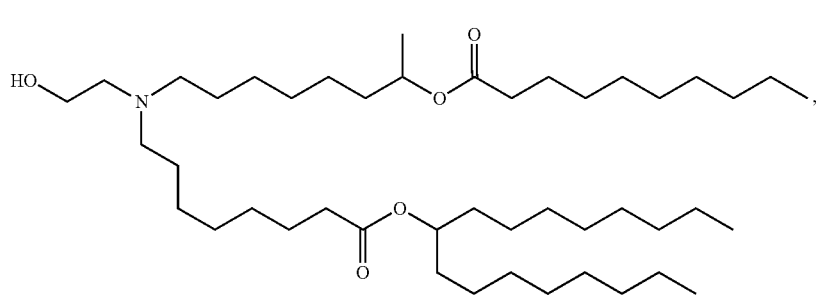
(Compound 98)
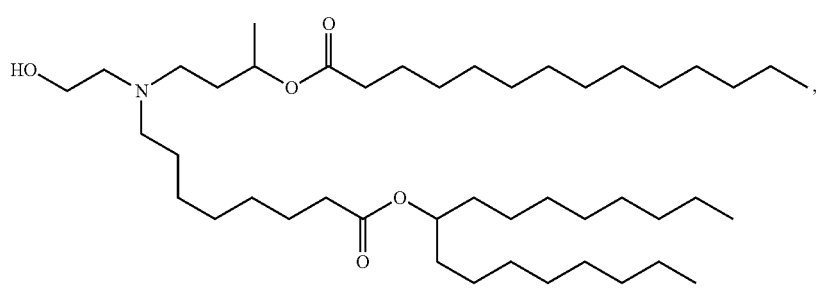
(Compound 99)

(Compound 100)
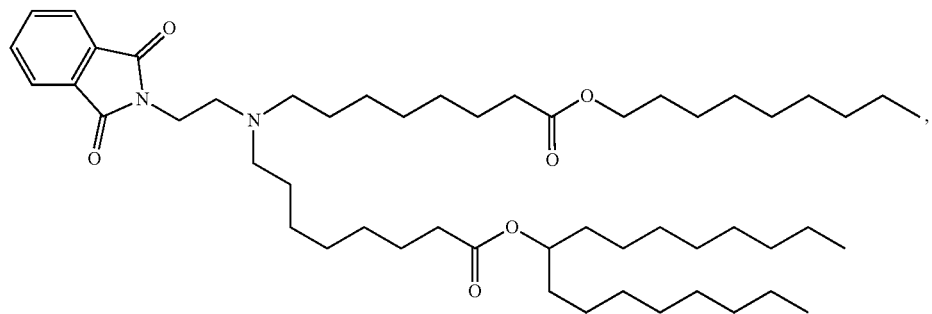
(Compound 101)
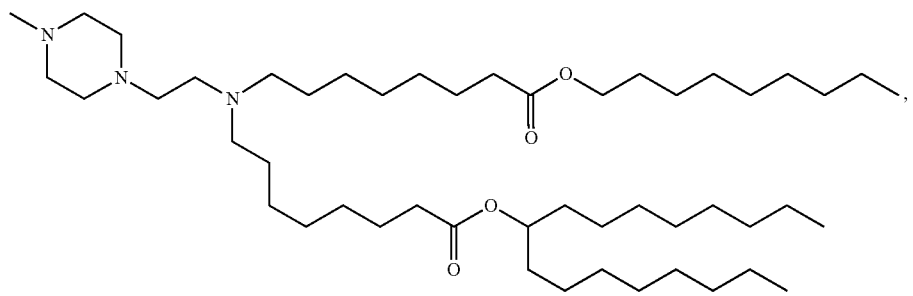
(Compound 102)
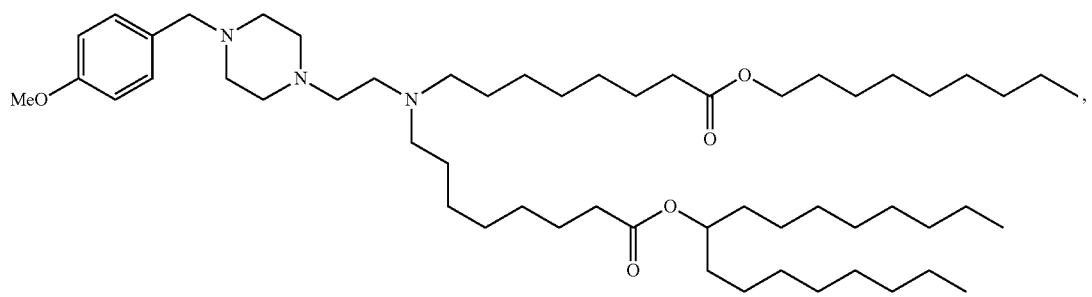
(Compound 103)
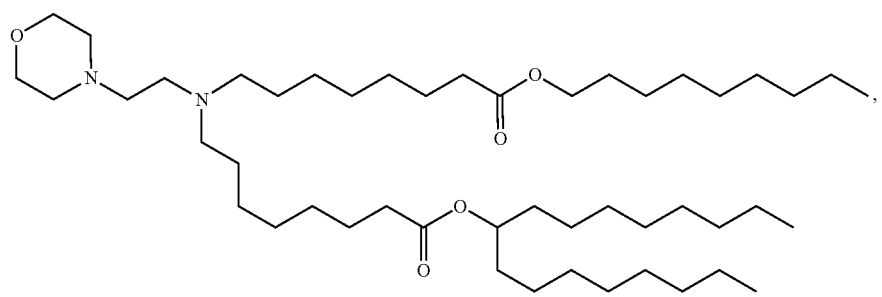
(Compound 104)
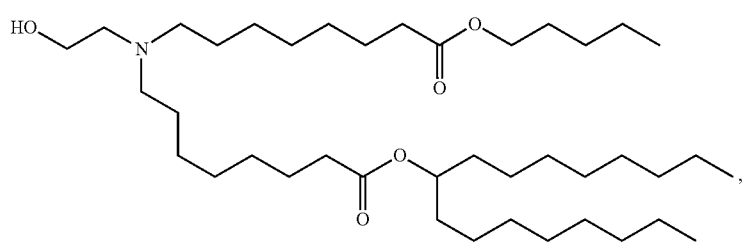

(Compound 105)
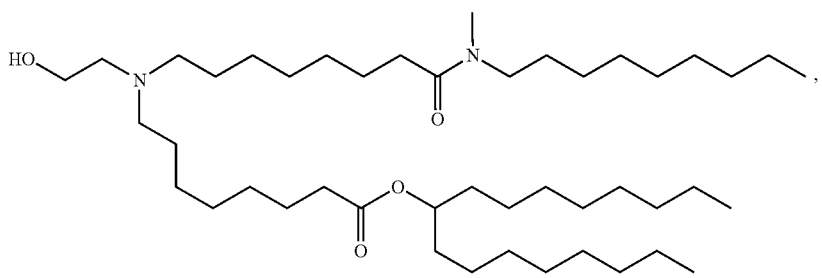
(Compound 106)
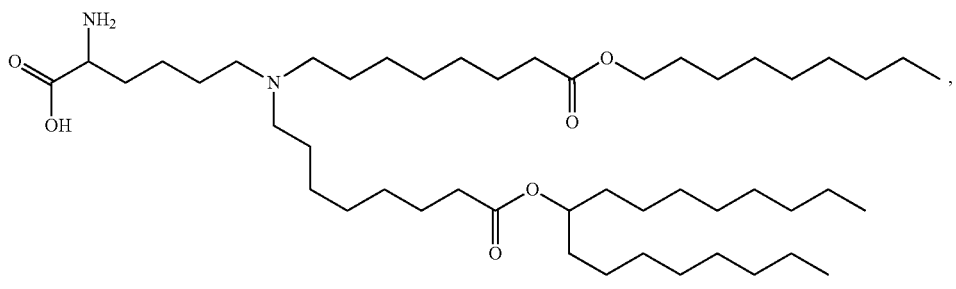
(Compound 107)
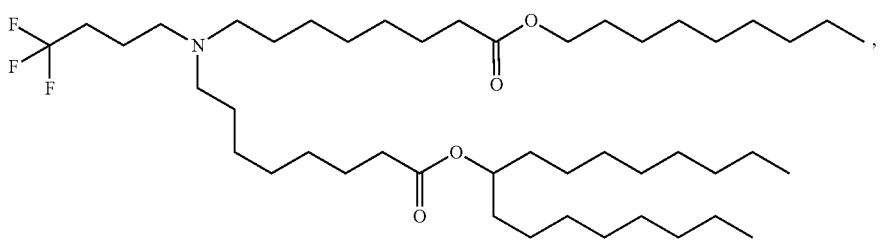
(Compound 108)
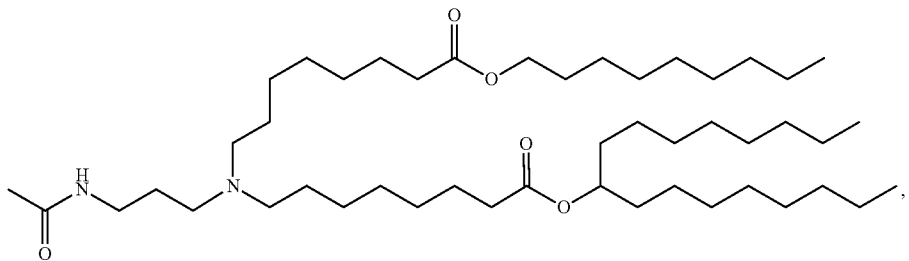
(Compound 109)
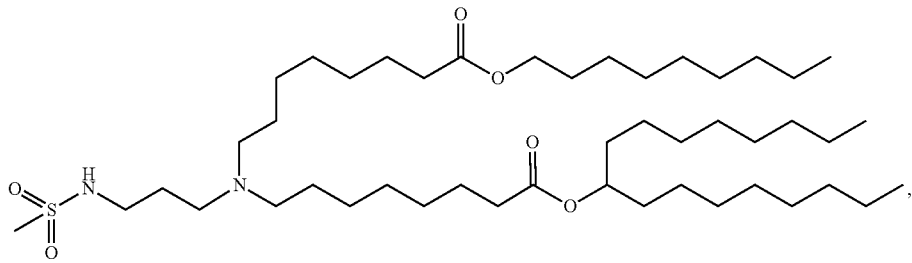
(Compound 110)
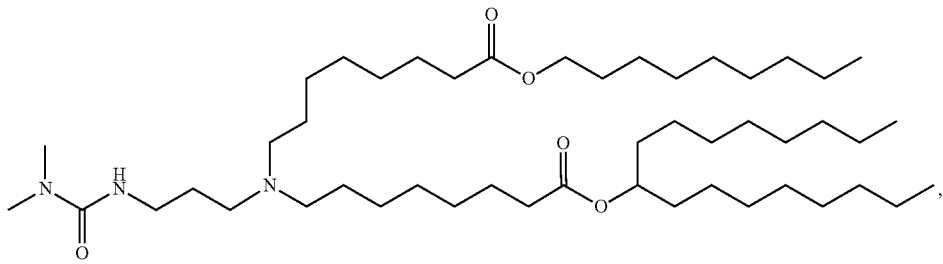

(Compound 111)
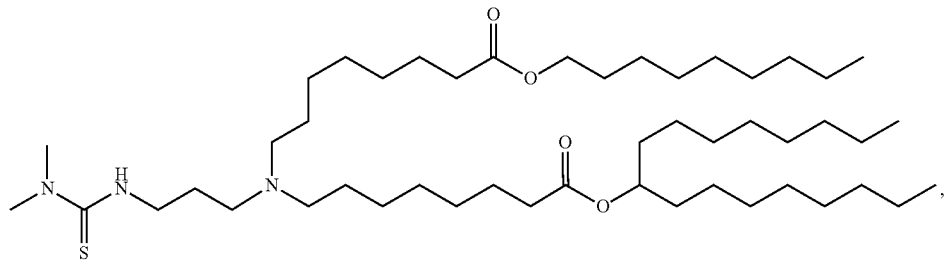
(Compound 112)
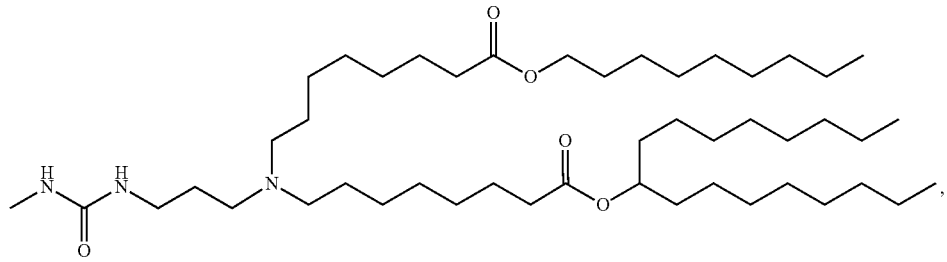
(Compound 113)
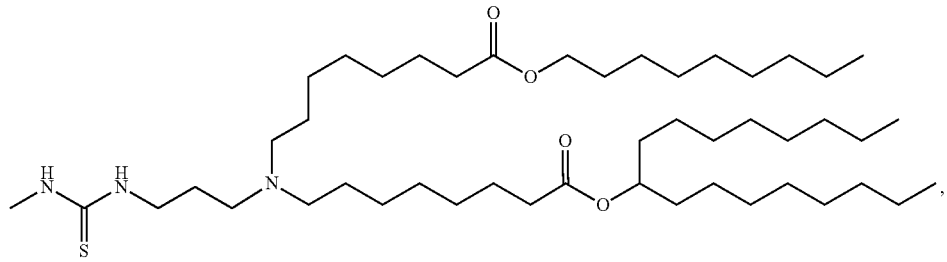
(Compound 114)
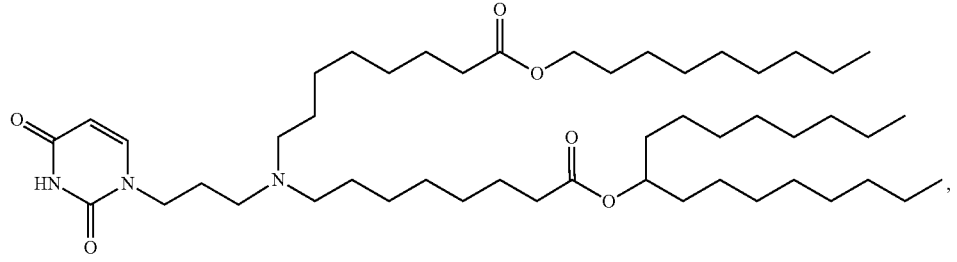
(Compound 115)
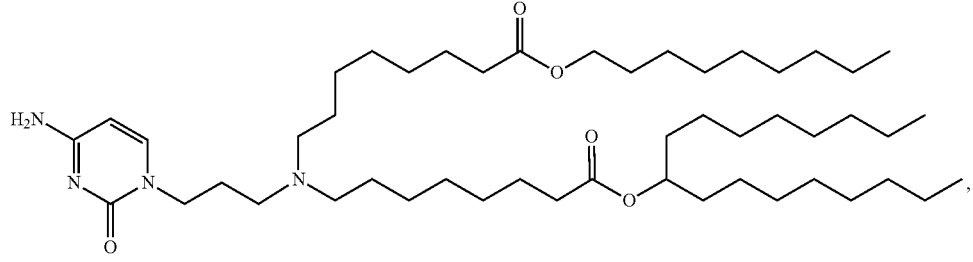
(Compound 116)
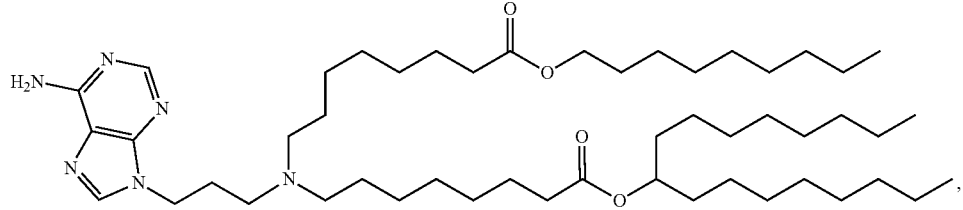

-continued
(Compound 117)
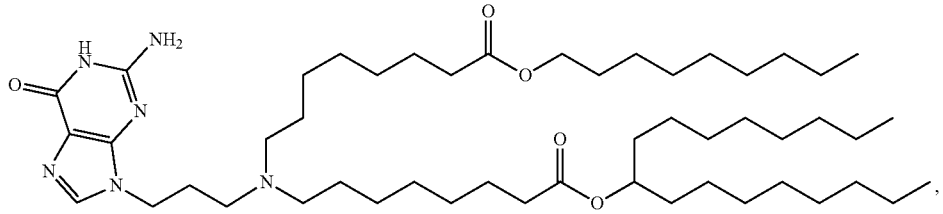
(Compound 118)
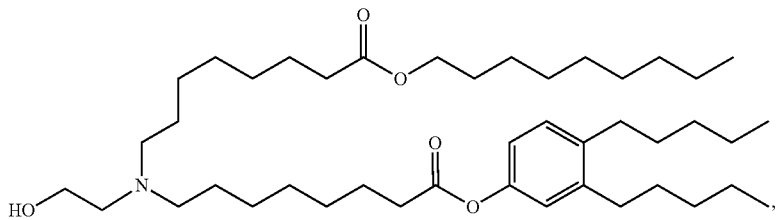
(Compound 119)
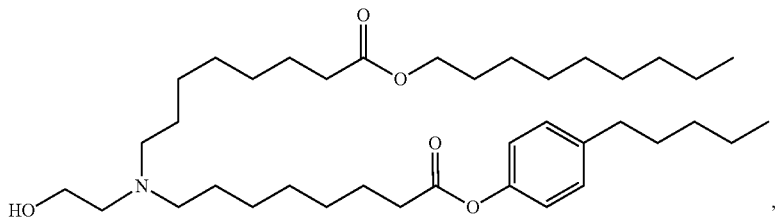
(Compound 120)
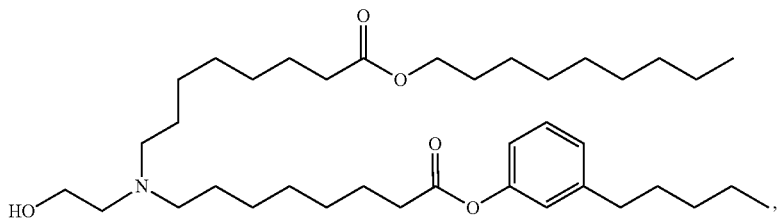
(Compound 121)
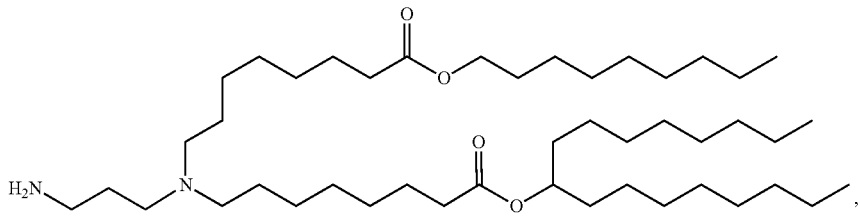
(Compound 122)
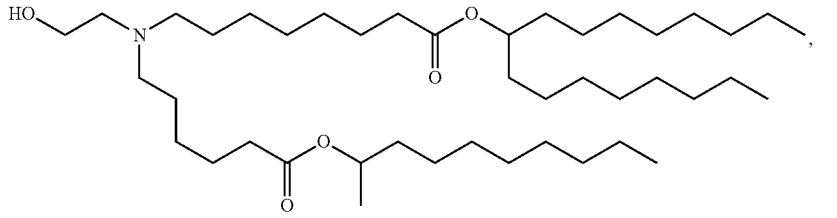
(Compound 123)
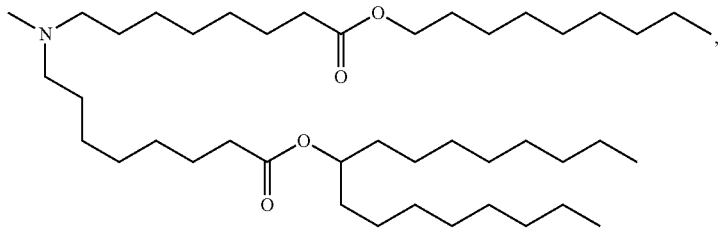

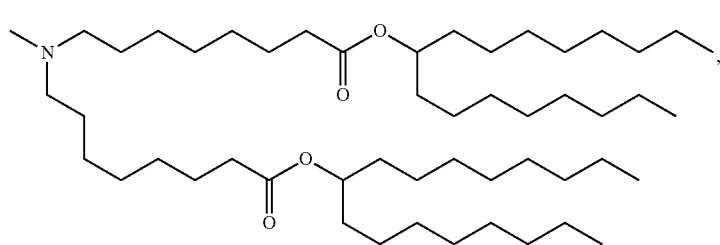
(Compound 124)
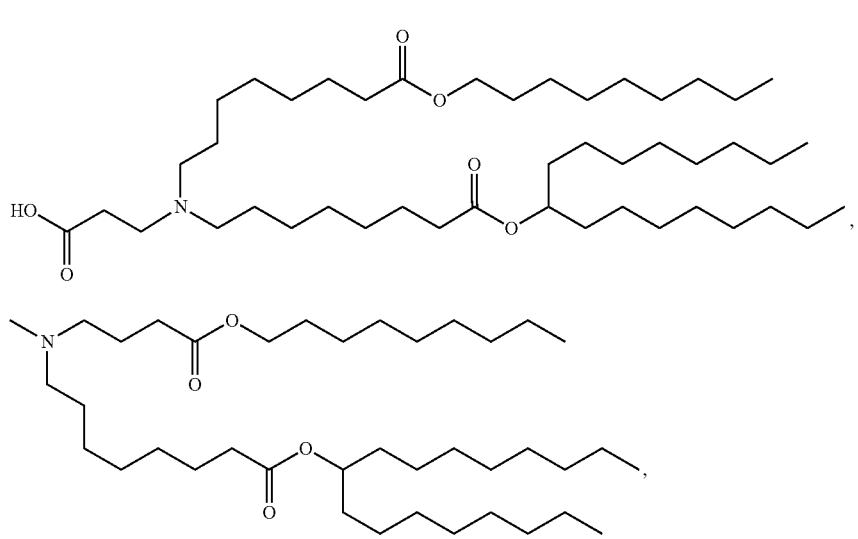
(Compound 125)
(Compound 126)
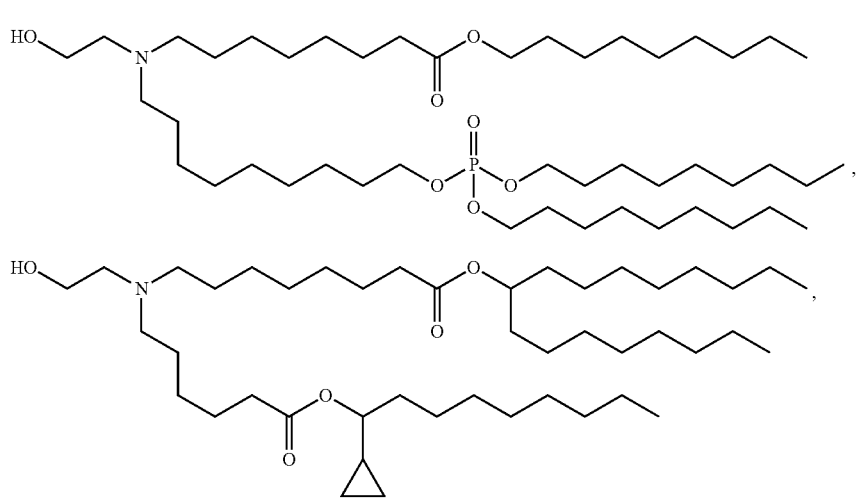
(Compound 127)
(Compound 128)
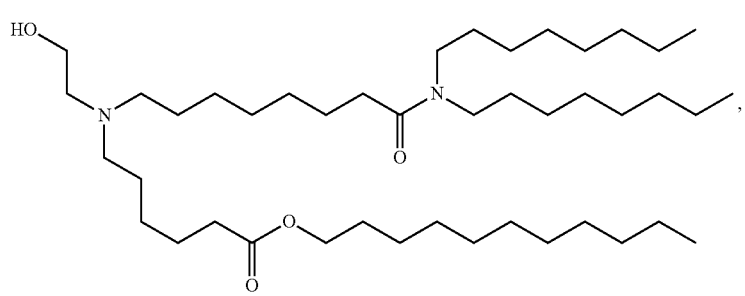
(Compound 129)

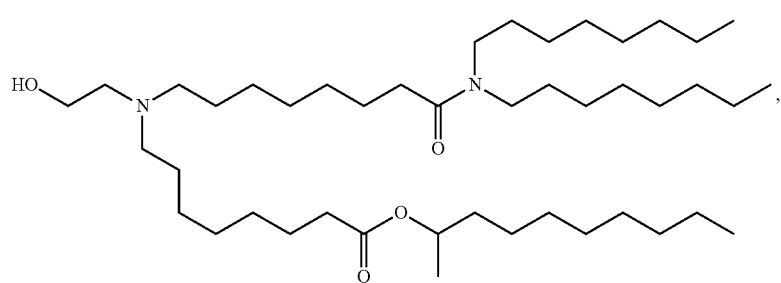
(Compound 130)
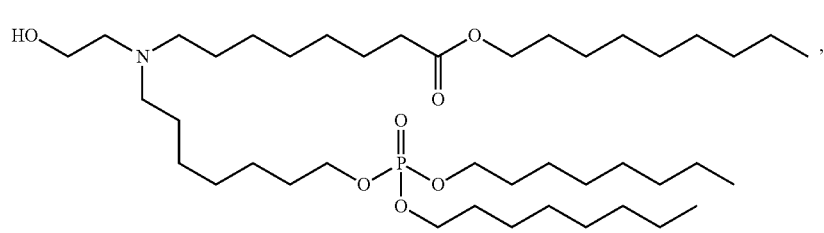
(Compound 131)
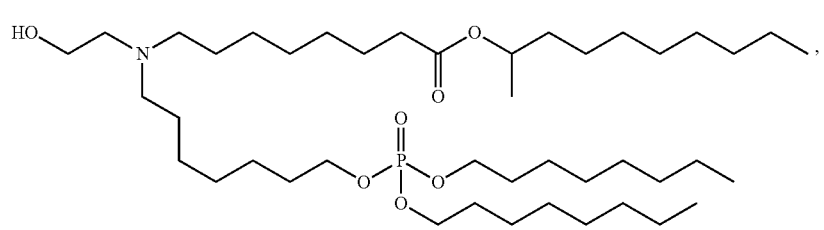
(Compound 132)
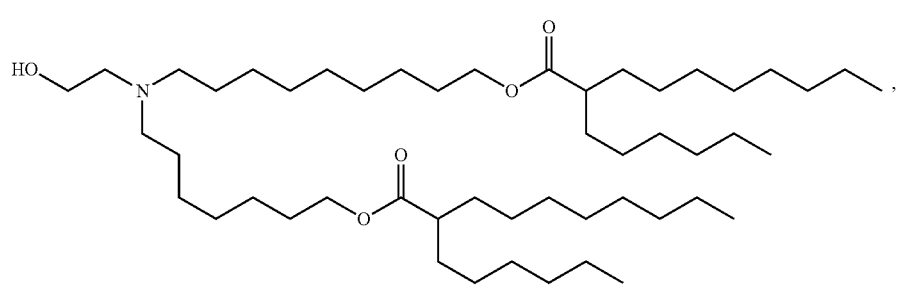
(Compound 133)
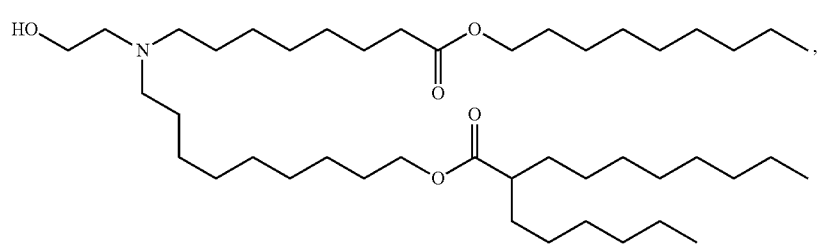
(Compound 134)
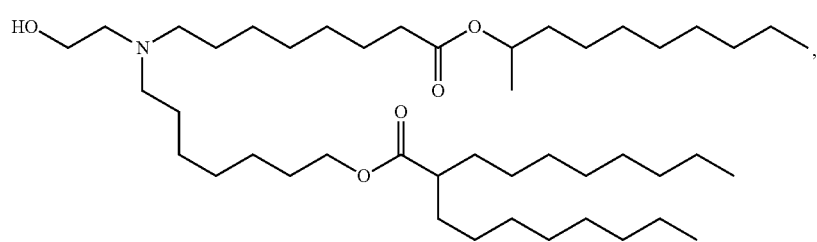
(Compound 135)

-continued
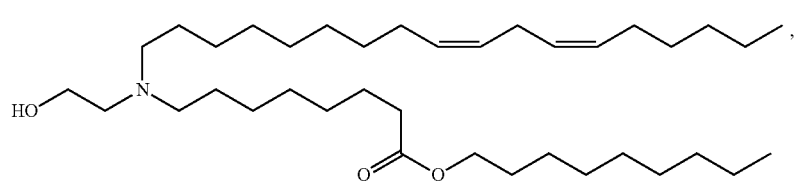
(Compound 136)
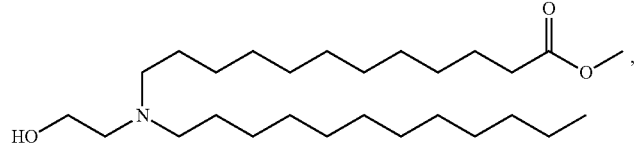
(Compound 137)
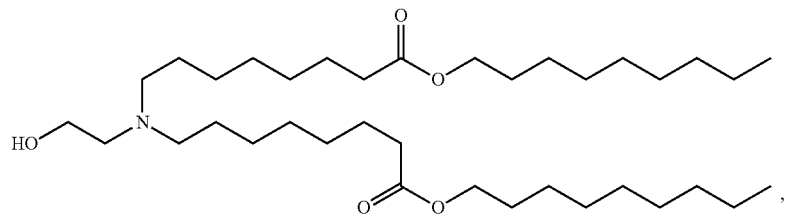
(Compound 138)
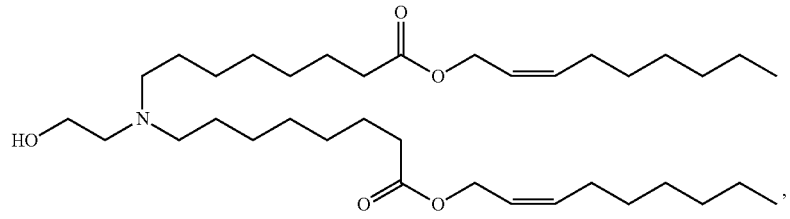
(Compound 139)
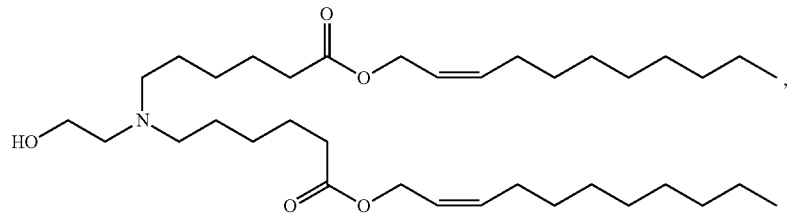
(Compound 140)
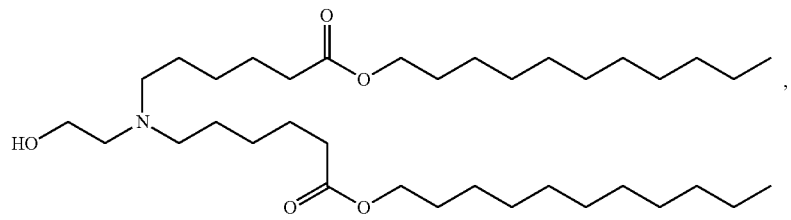
(Compound 141)
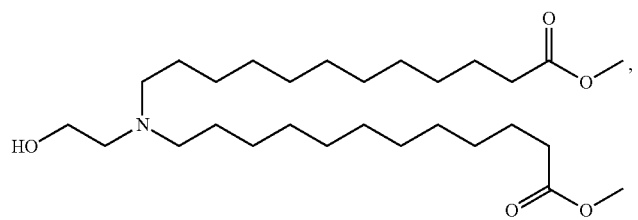
(Compound 142)

(Compound 143)
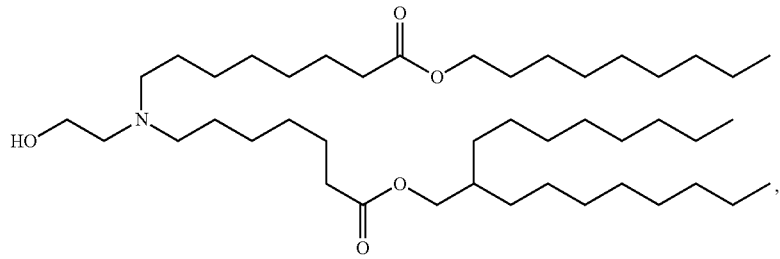
(Compound 144)
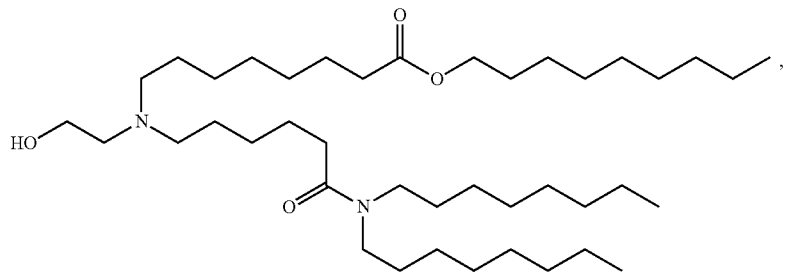
(Compound 145)
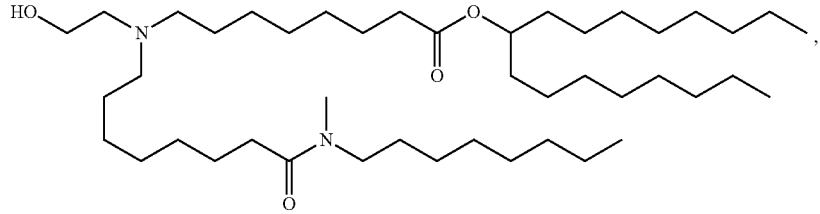
(Compound 146)
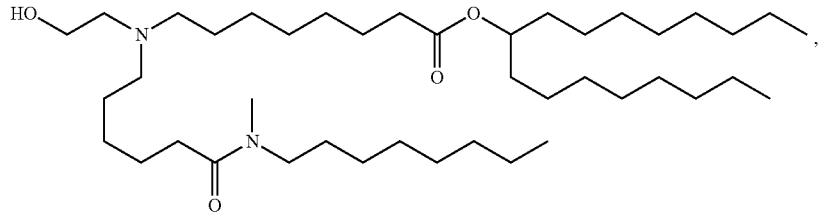
(Compound 147)
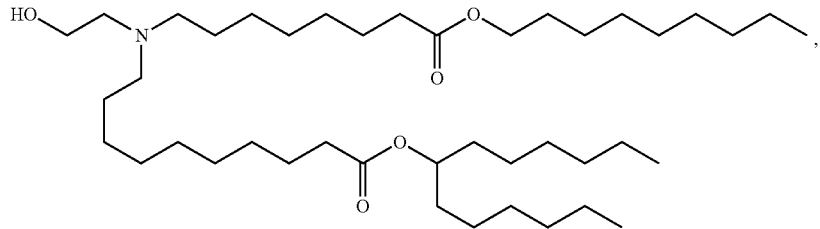
(Compound 148)
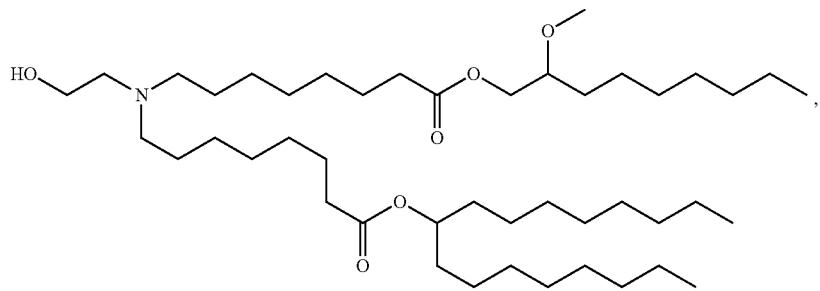

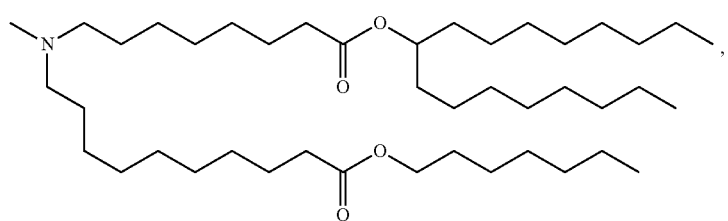
(Compound 149)
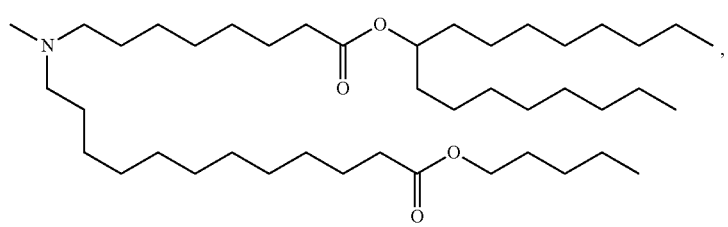
(Compound 150)
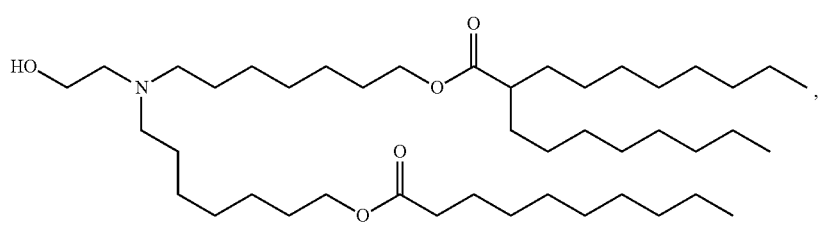
(Compound 151)
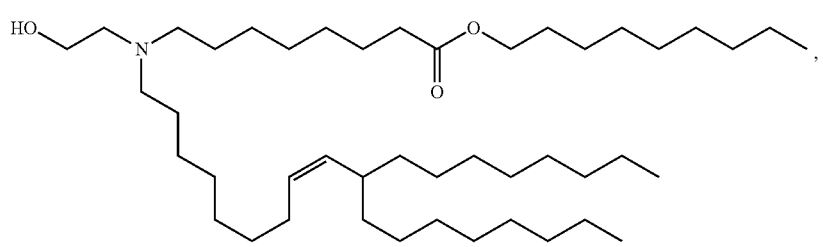
(Compound 152)
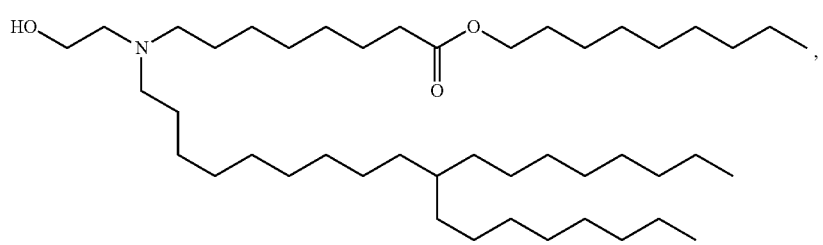
(Compound 153)
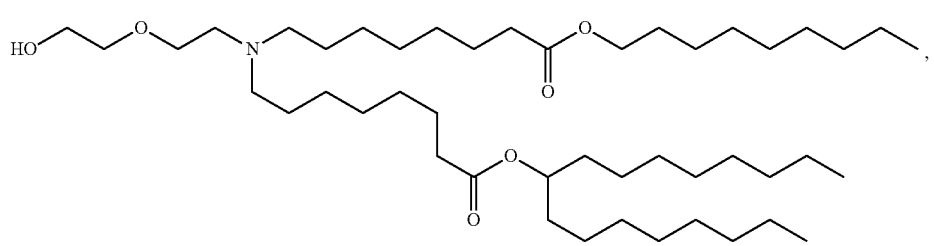
(Compound 154)
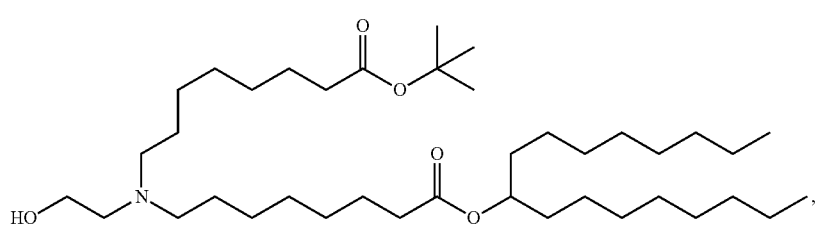
(Compound 155)

-continued
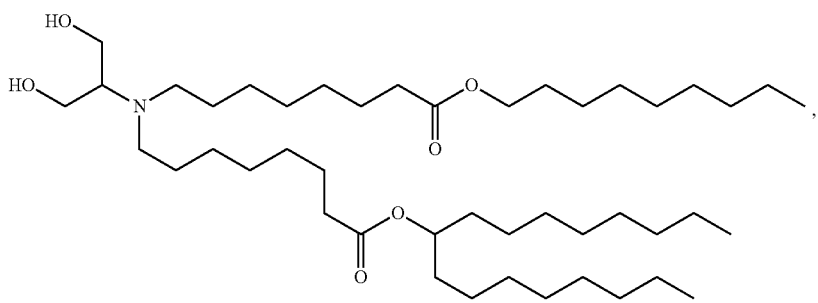
(Compound 156)
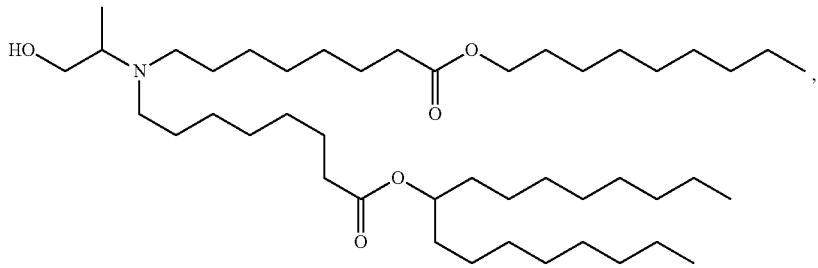
(Compound 157)
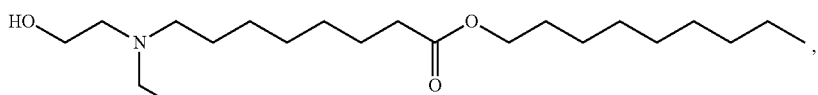
(Compound 158)
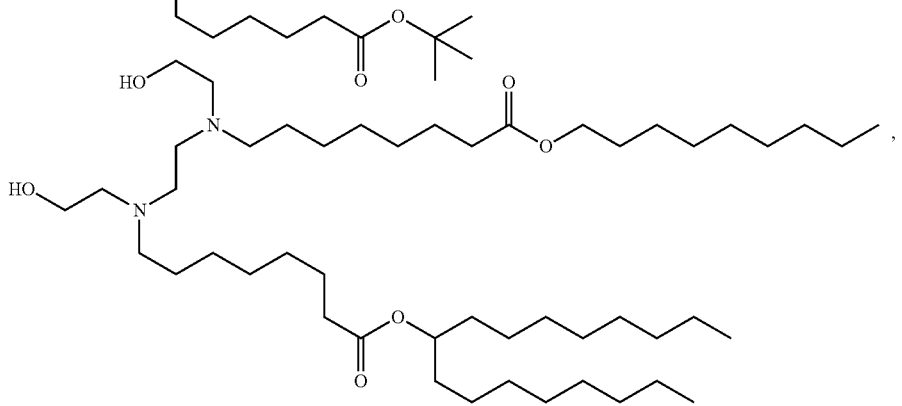
(Compound 159)
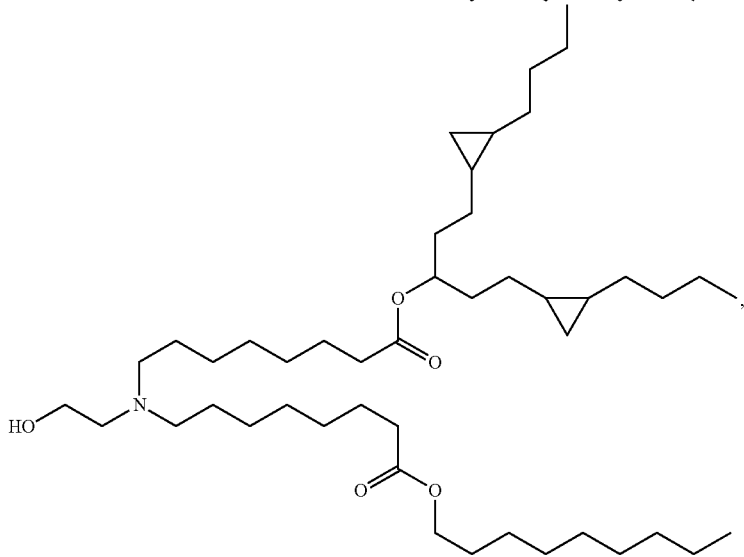
(Compound 160)

(Compound 161)
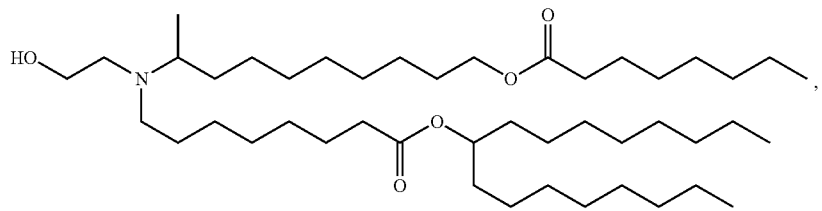
(Compound 162)
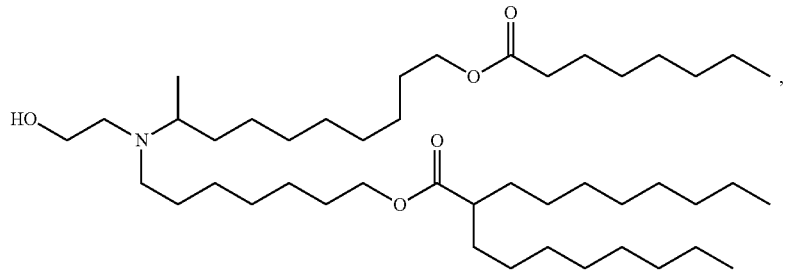
(Compound 163)
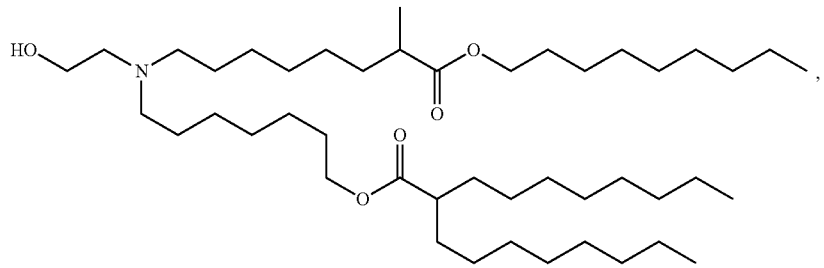
(Compound 164)
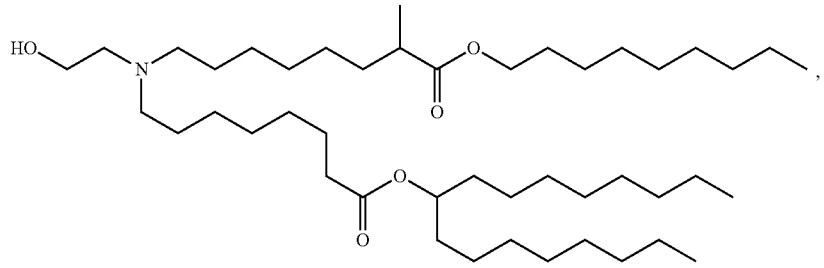
(Compound 165)
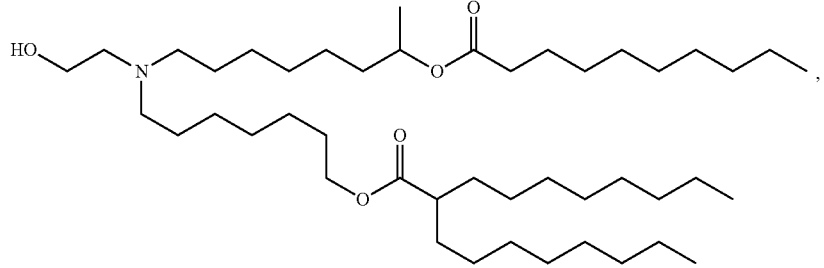
(Compound 166)
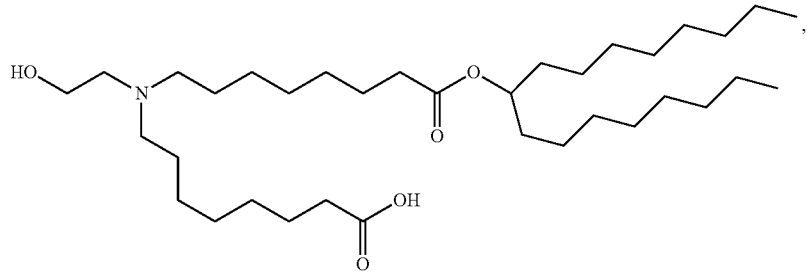

-continued
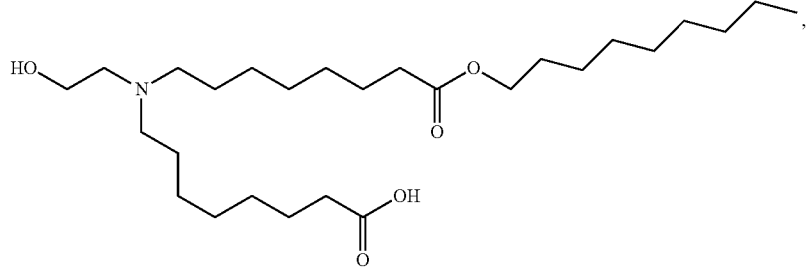
(Compound 167)
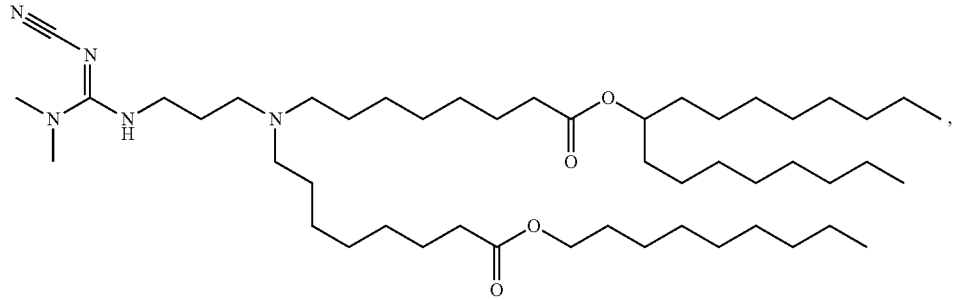
(Compound 168)
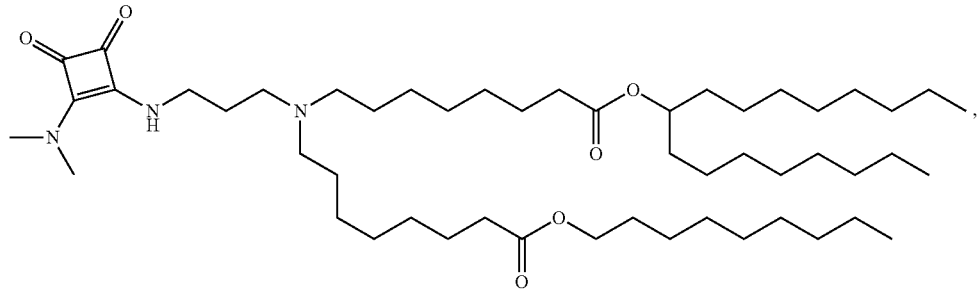
(Compound 169)
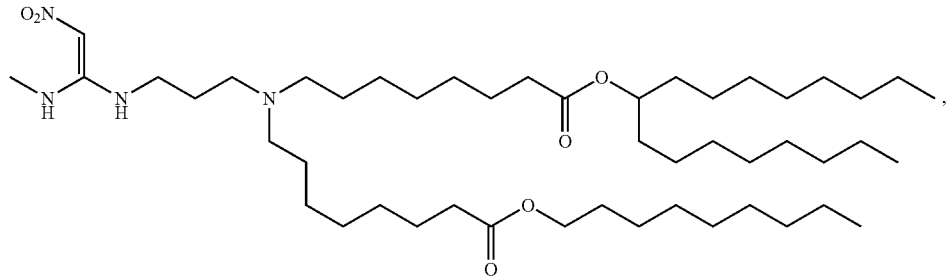
(Compound 170)
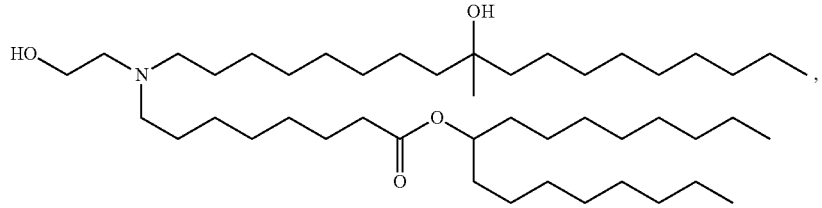
(Compound 171)
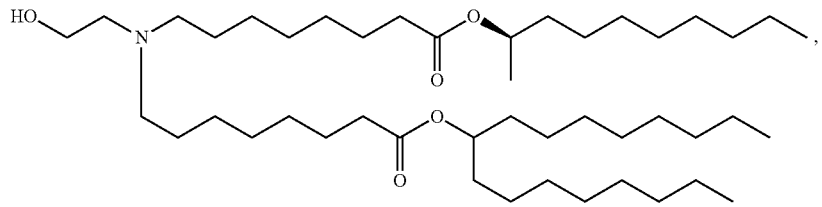
(Compound 172)

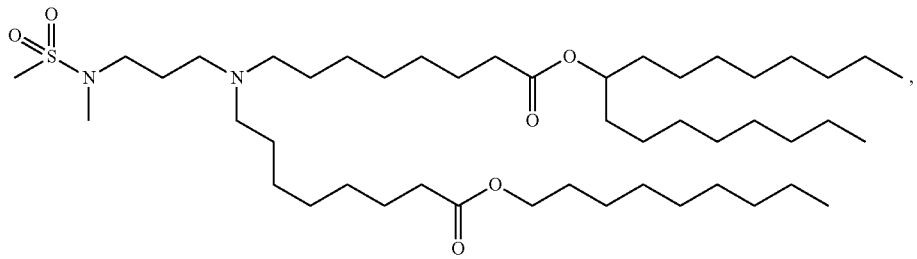
(Compound 173)
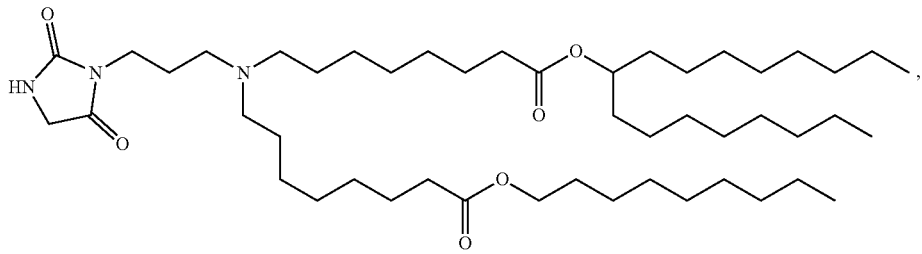
(Compound 174)
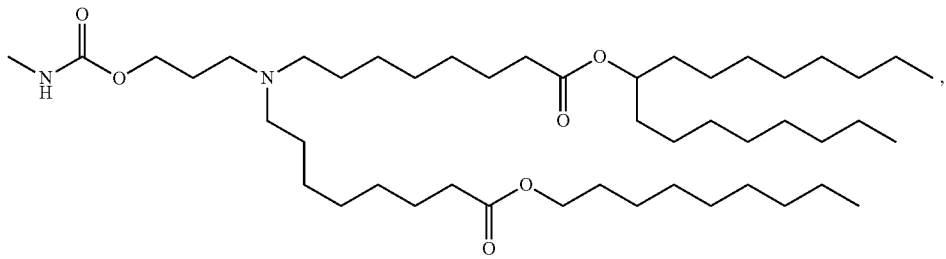
(Compound 175)
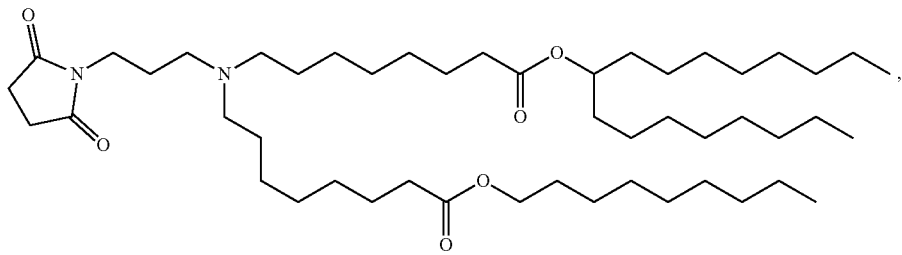
(Compound 176)
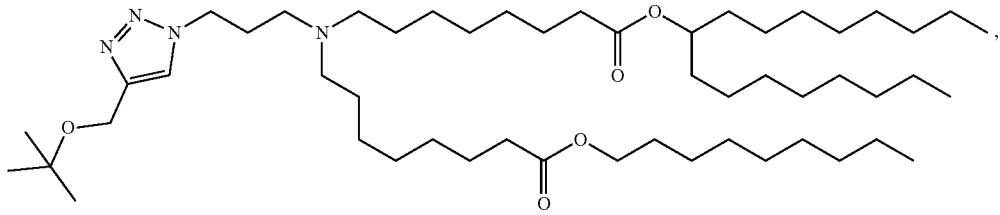
(Compound 177)
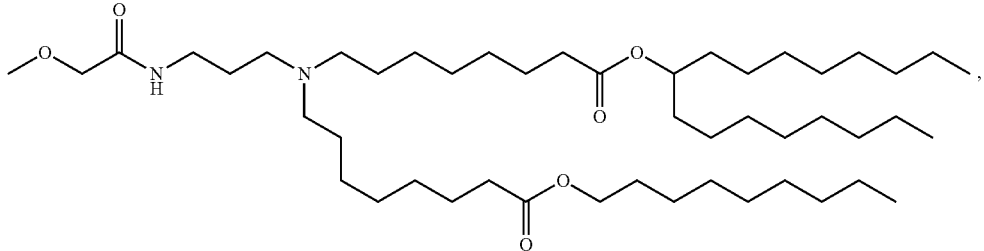
(Compound 178)

(Compound 179)
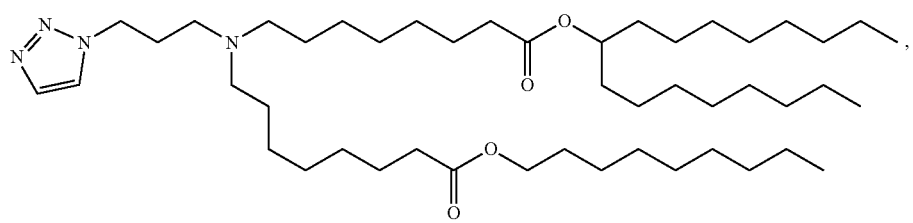
(Compound 180)
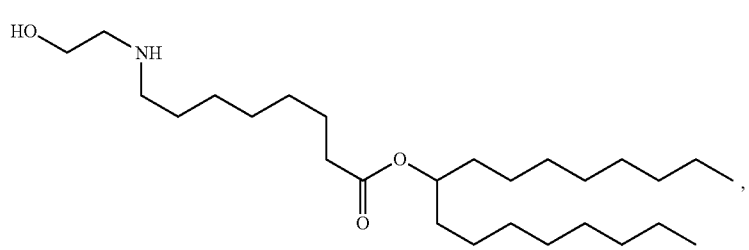
(Compound 181)
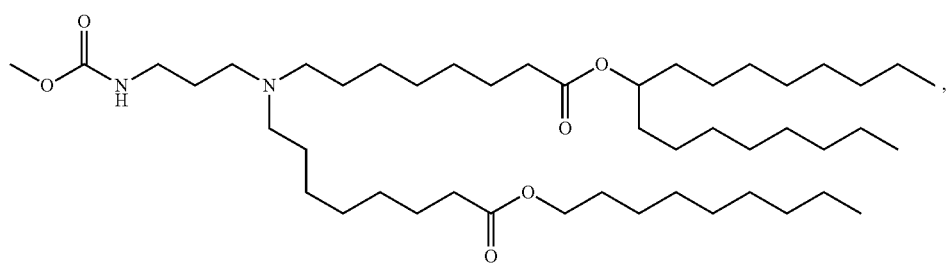
(Compound 182)
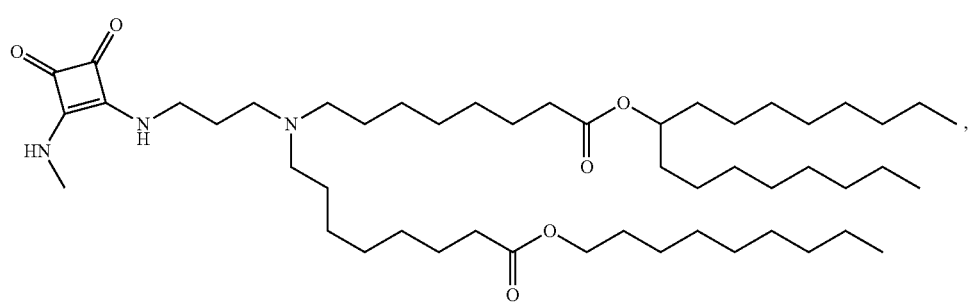
(Compound 183)
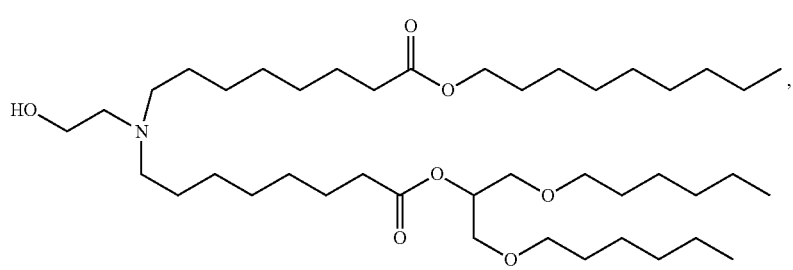
(Compound 184)
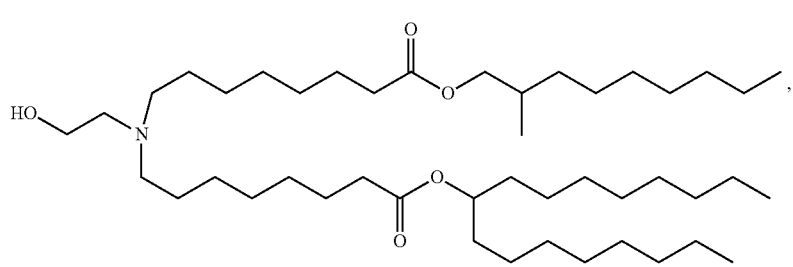

-continued
(Compound 185)
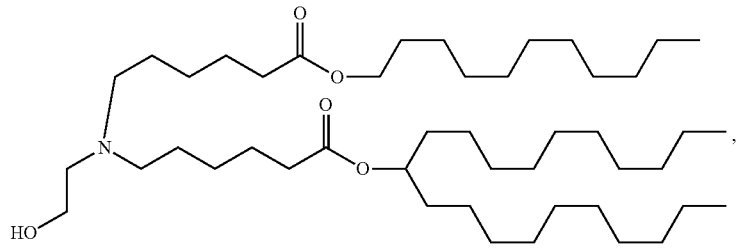
(Compound 186)
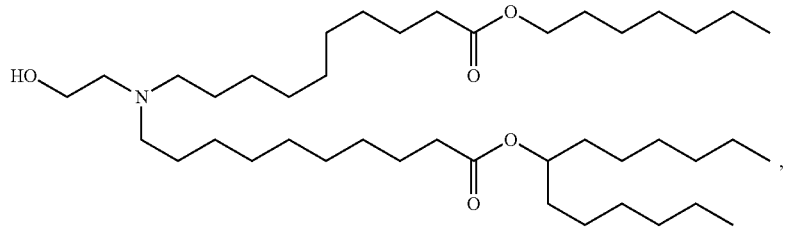
(Compound 187)
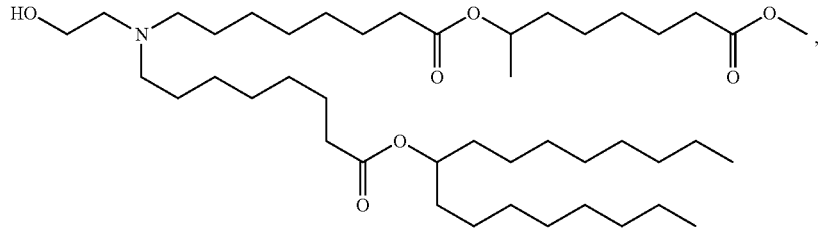
(Compound 188)
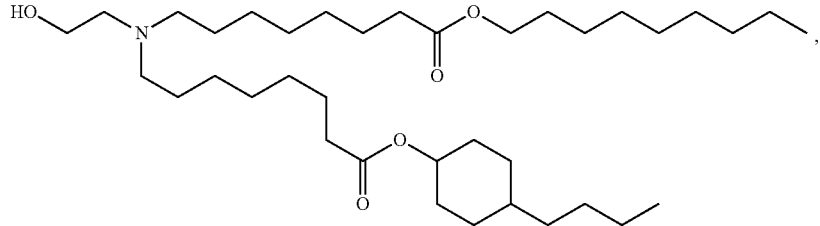
(Compound 189)
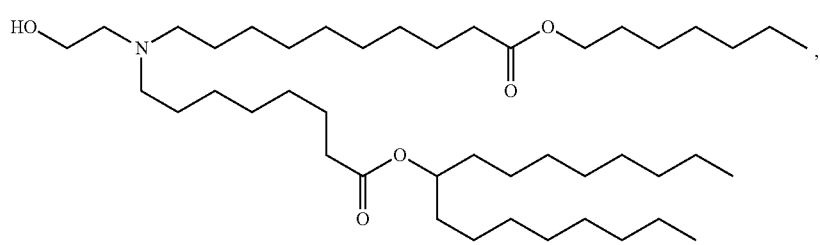
(Compound 190)
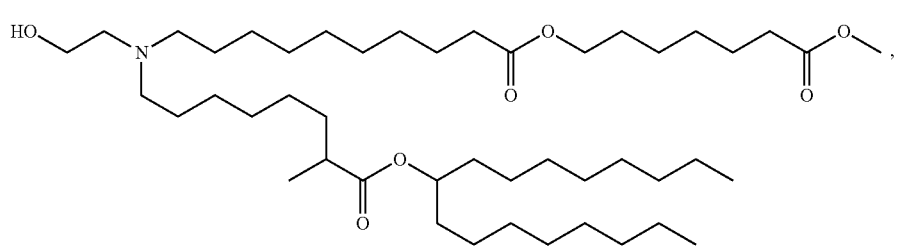

-continued
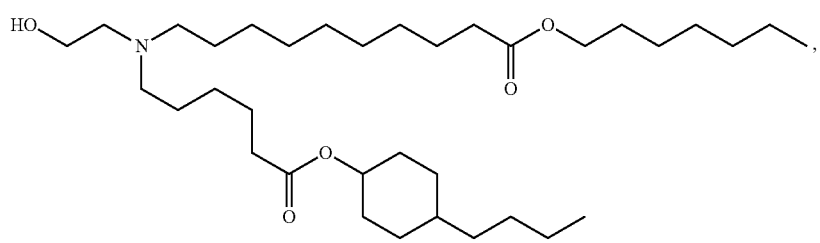
(Compound 191)
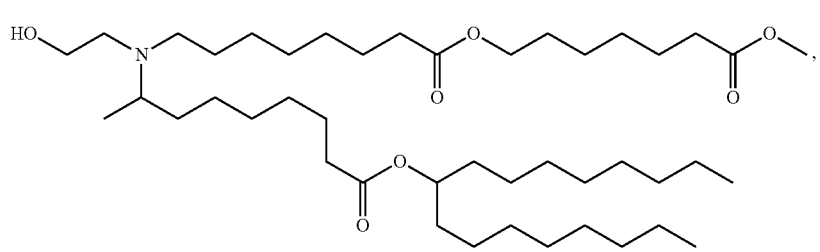
(Compound 192)
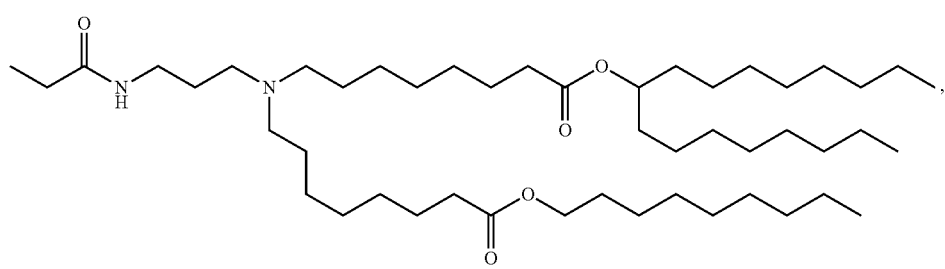
(Compound 193)
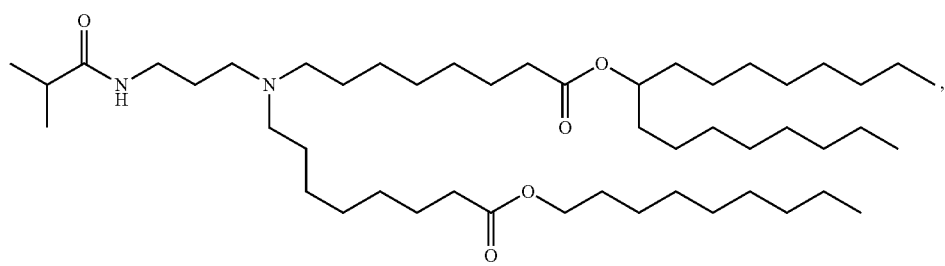
(Compound 194)
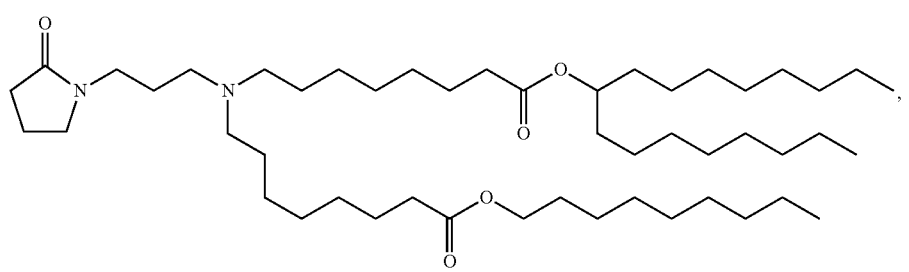
(Compound 195)
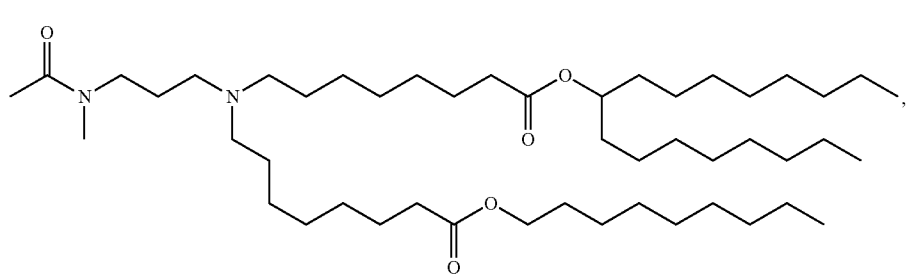
(Compound 196)

(Compound 197)
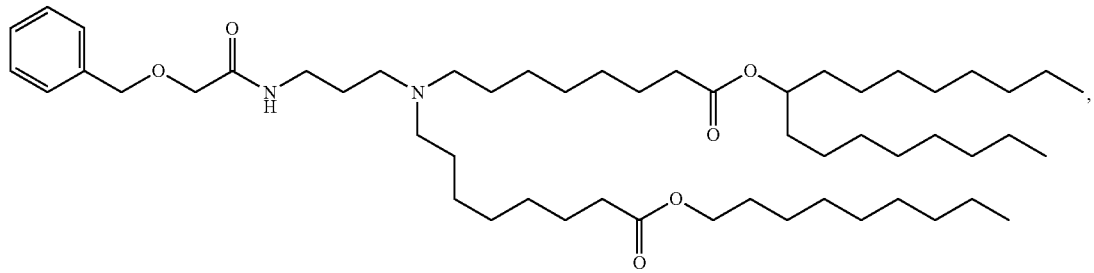
(Compound 198)
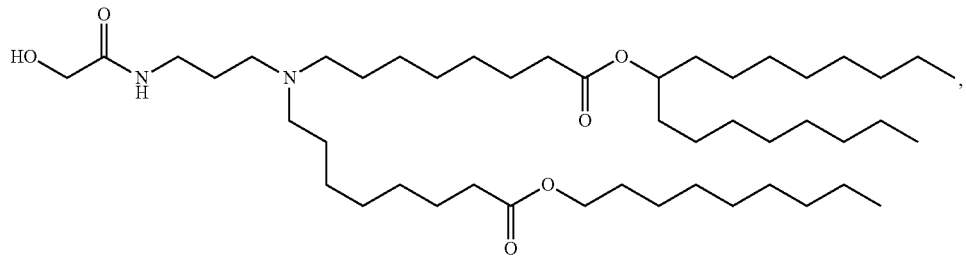
(Compound 199)
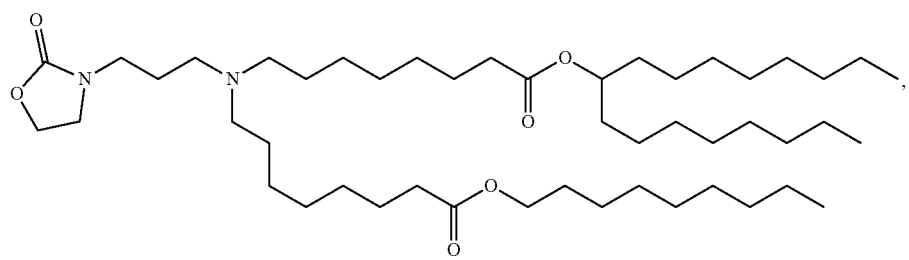
(Compound 200)
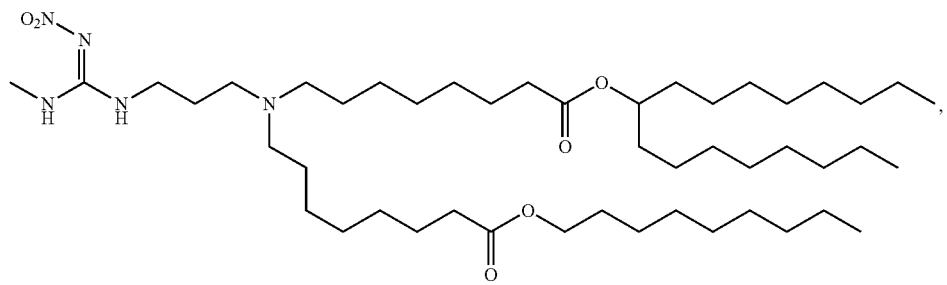
(Compound 201)
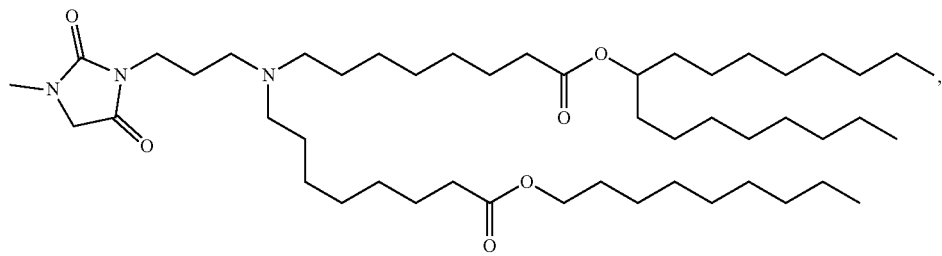
(Compund 202)
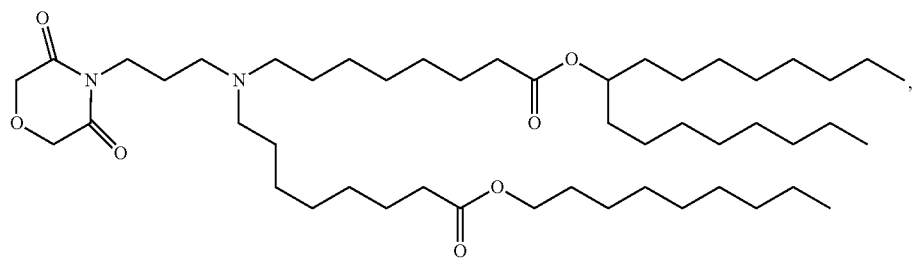

(Compound 203)
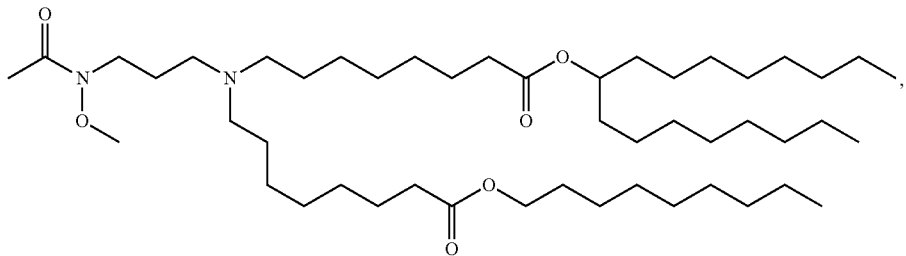
(Compound 204)
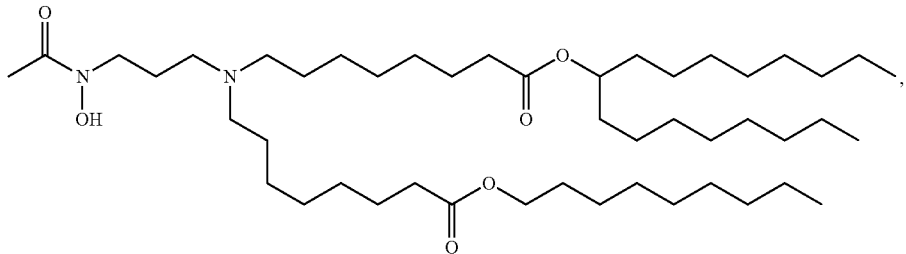
(Compound 205)
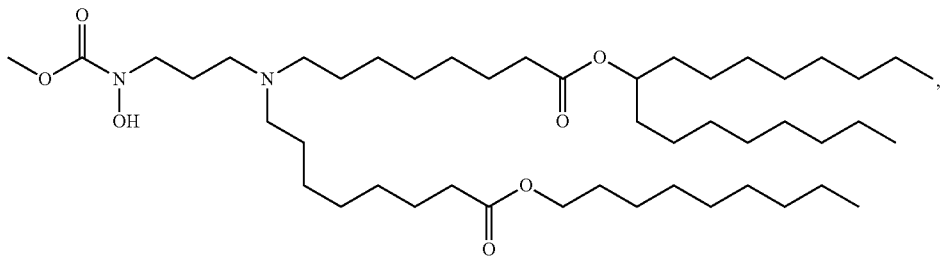
(Compound 206)
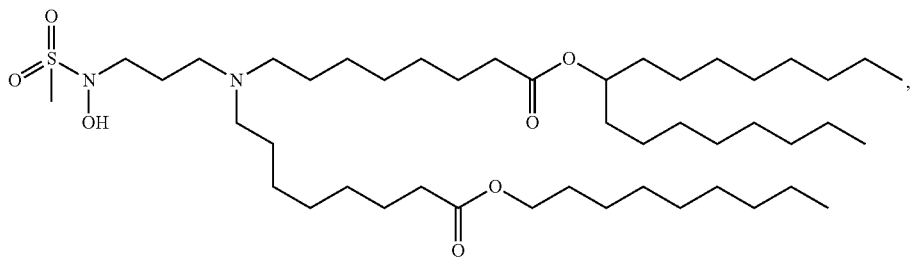
(Compound 207)
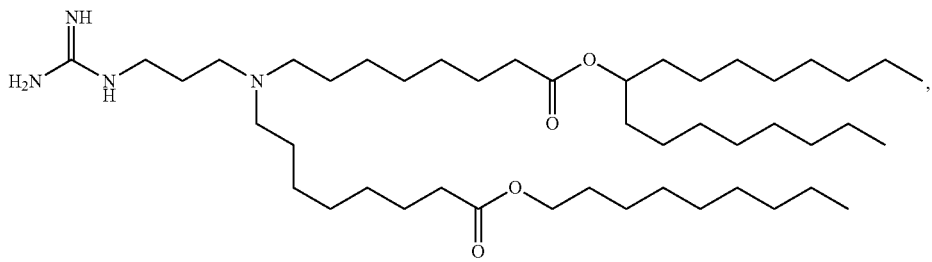
(Compound 208)
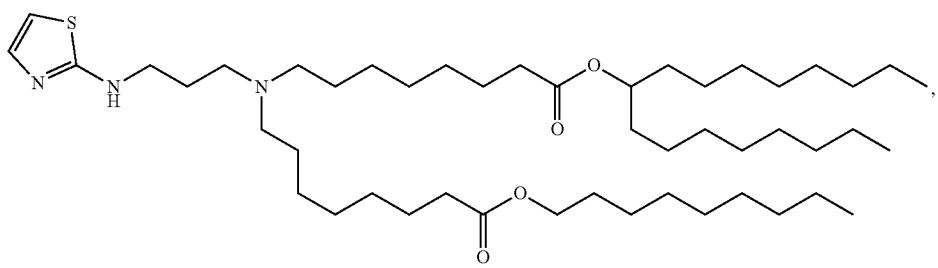

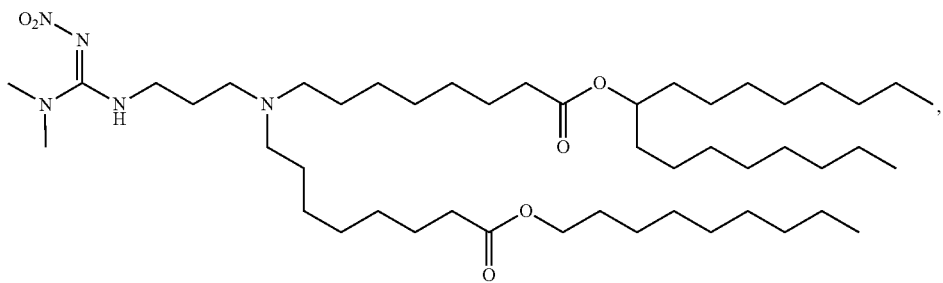
(Compound 209)
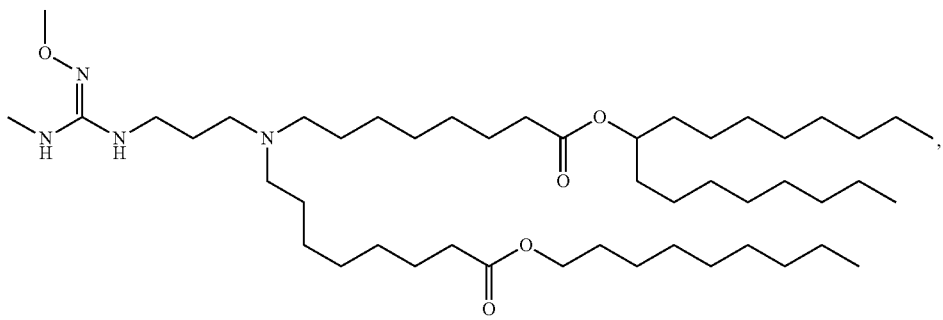
(Compound 210)
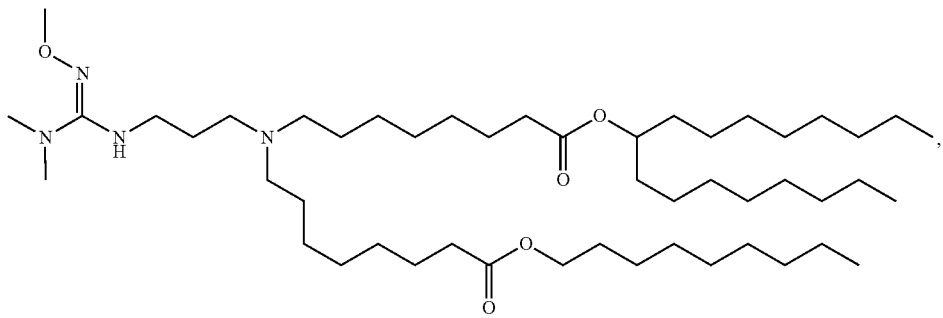
(Compound 211)
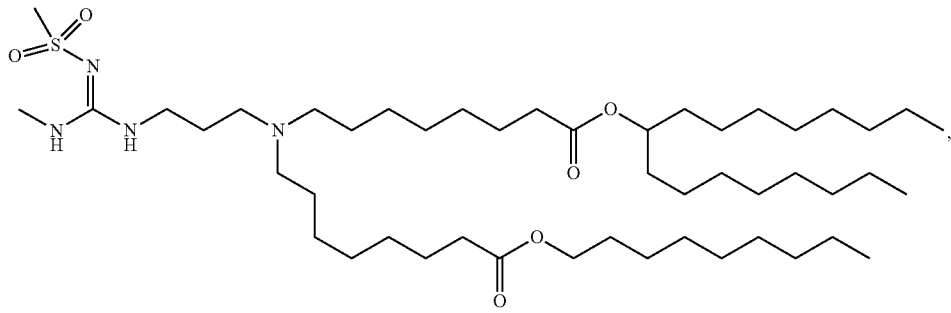
(Compound 212)
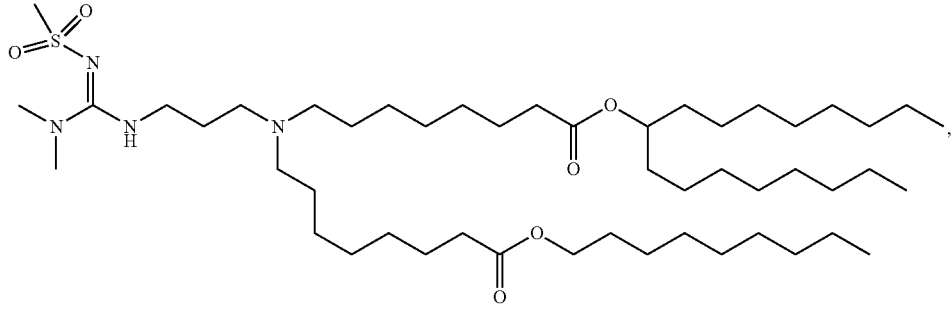
(Compound 213)

-continued
(Compound 214)
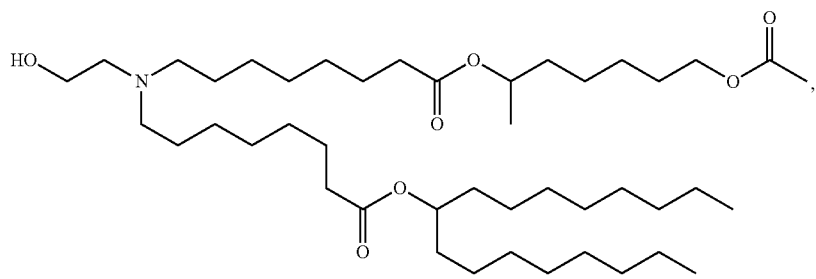
(Compound 215)
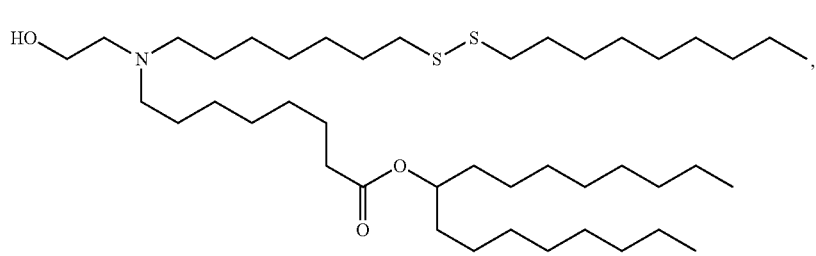
(Compound 216)
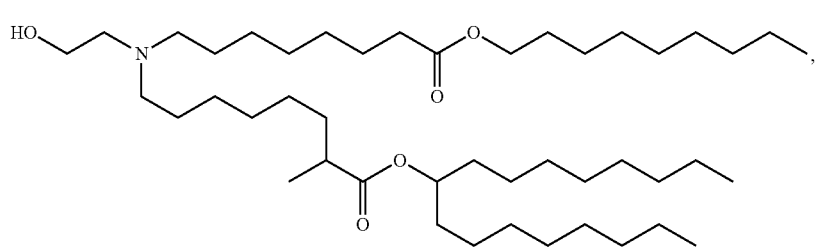
(Compound 217)
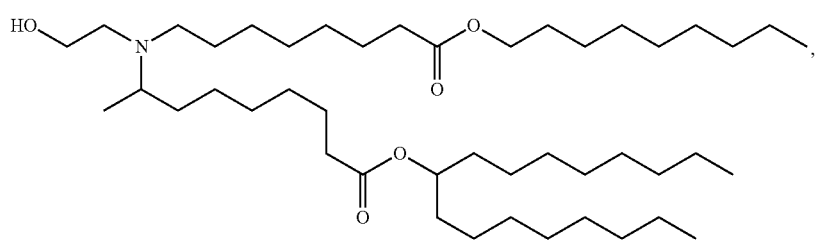
(Compound 218)
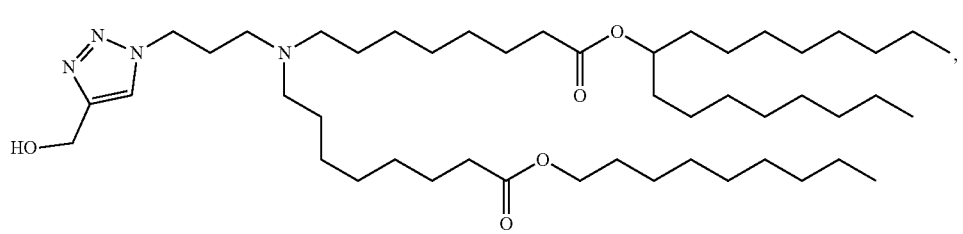
(Compound 219)
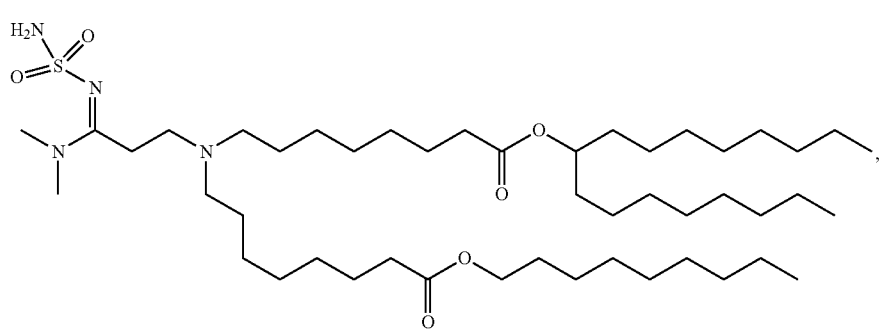

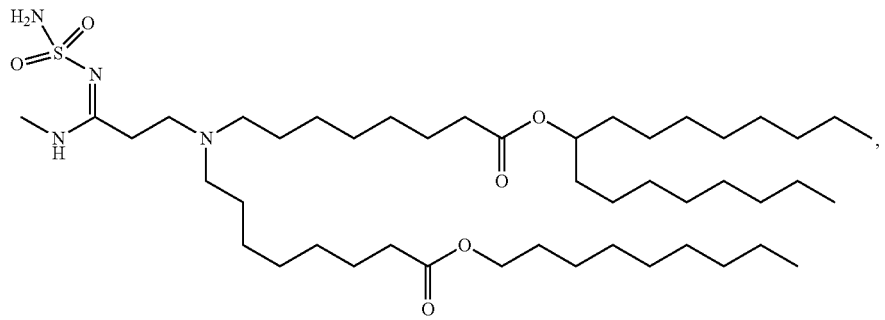
(Compound 220)
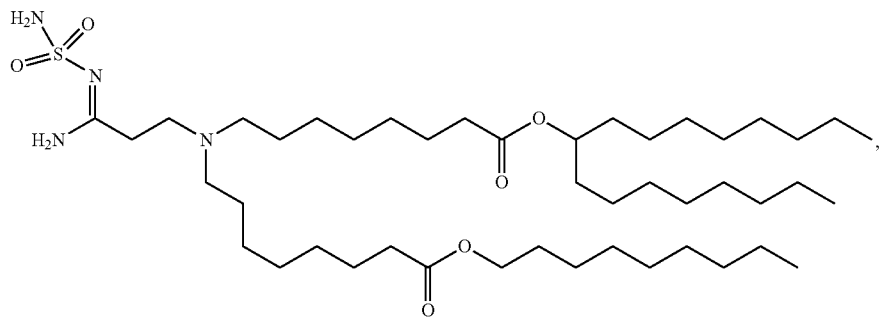
(Compound 221)
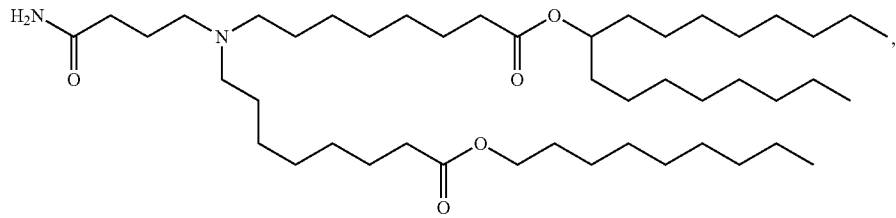
(Compound 222)
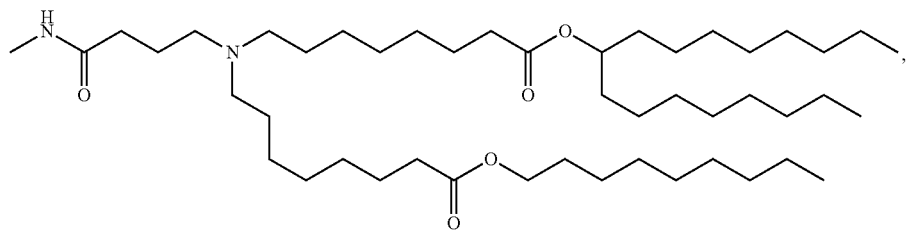
(Compound 223)
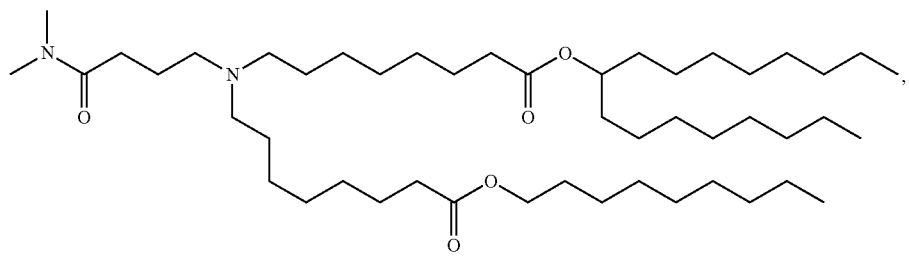
(Compound 224)
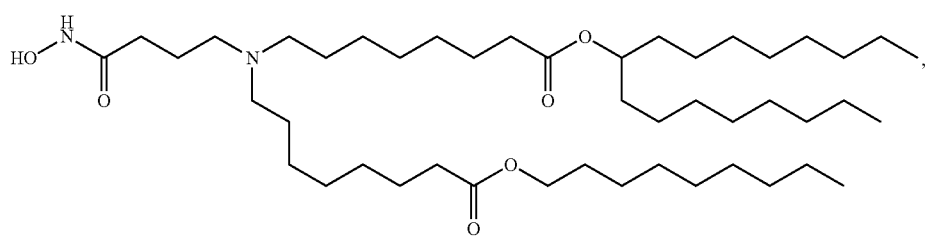
(Compound 225)

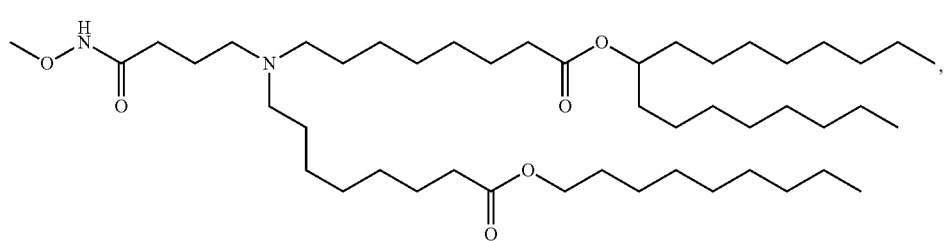
(Compound 226)
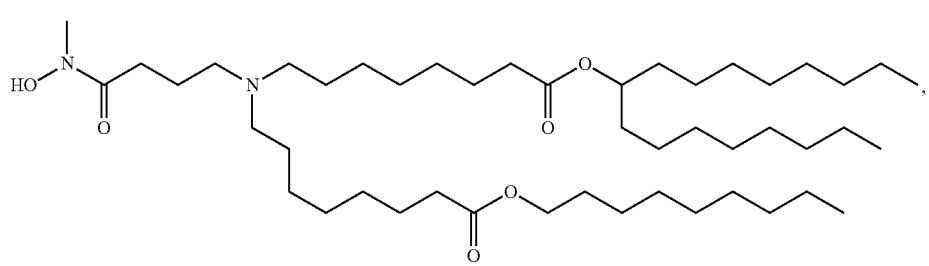
(Compound 227)
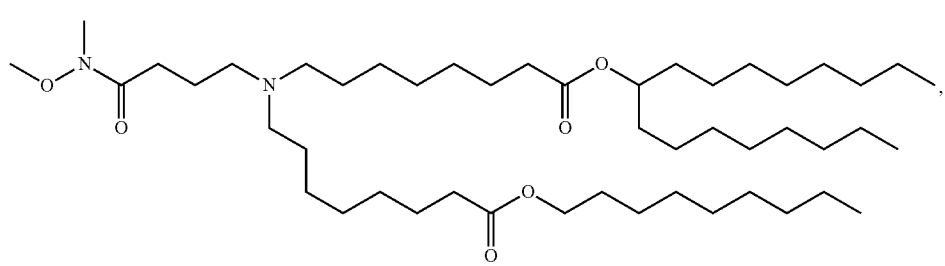
(Compound 228)
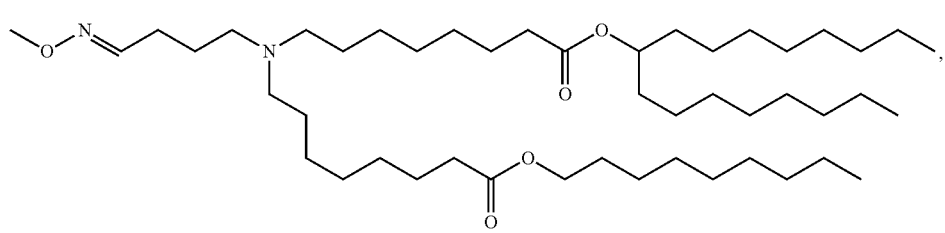
(Compound 229)
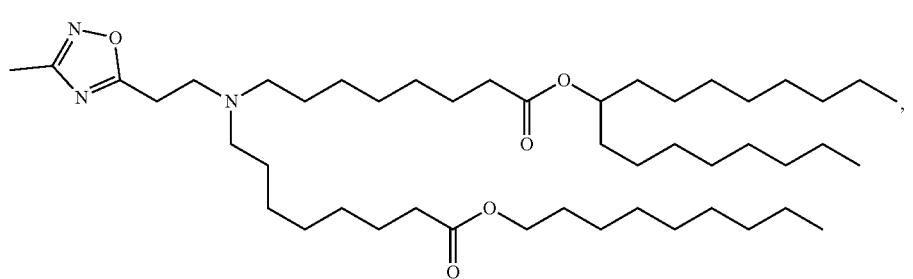
(Compound 230)
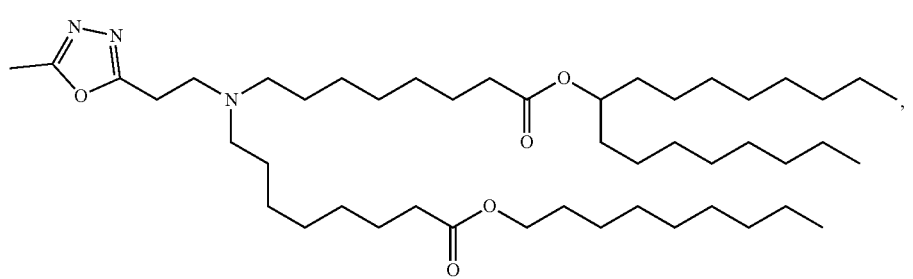
(Compound 231)

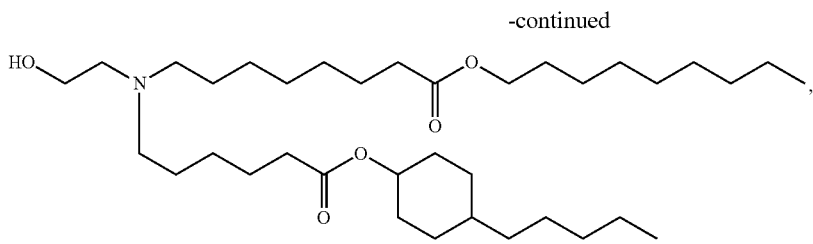

(Compound 232)

and salts and isomers thereof.

In some embodiments, a nanoparticle comprises the following compound:

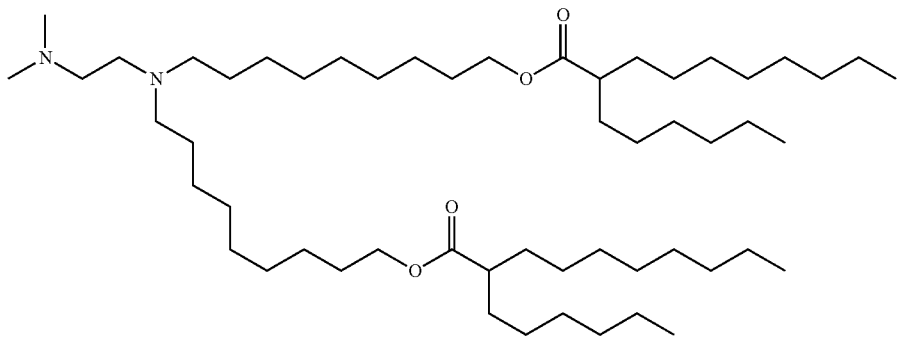

(Compound 233)

or salts and isomers thereof.

In some embodiments, the disclosure features a nanoparticle composition including a lipid component comprising a compound as described herein (e.g., a compound according to Formula (I), (IA), (II), (IIa), (IIb), (IIc), (IId) or (IIe)).

In some embodiments, the disclosure features a pharmaceutical composition comprising a nanoparticle composition according to the preceding embodiments and a pharmaceutically acceptable carrier. For example, the pharmaceutical composition is refrigerated or frozen for storage and/or shipment (e.g., being stored at a temperature of 4° C. or lower, such as a temperature between about −150° C., and about 0° C., or between about −80° C., and about −20° C. (e.g., about −5° C., −10° C., −15° C., −20° C., −25° C., −30° C., −40° C., −50° C., −60° C., −70° C., −80° C., −90° C., −130° C., or −150° C.). For example, the pharmaceutical composition is a solution that is refrigerated for storage and/or shipment at, for example, about −20° C., −30° C., −40° C., −50° C., −60° C., −70° C., or −80° C.

In some embodiments, the disclosure provides a method of delivering a therapeutic and/or prophylactic (e.g., RNA, such as mRNA) to a cell (e.g., a mammalian cell). This method includes the step of administering to a subject (e.g., a mammal, such as a human) a nanoparticle composition including (i) a lipid component including a phospholipid (such as a polyunsaturated lipid), a PEG lipid, a structural lipid, and a compound of Formula (I), (IA), (II), (IIa), (IIb), (IIc), (IId) or (IIe) and (ii) a therapeutic and/or prophylactic, in which administering involves contacting the cell with the nanoparticle composition, whereby the therapeutic and/or prophylactic is delivered to the cell.

In some embodiments, the disclosure provides a method of producing a polypeptide of interest in a cell (e.g., a mammalian cell). The method includes the step of contacting the cell with a nanoparticle composition including (i) a lipid component including a phospholipid (such as a polyunsaturated lipid), a PEG lipid, a structural lipid, and a compound of Formula (I), (IA), (II), (IIa), (IIb), (IIc), (IId) or (IIe) and (ii) an mRNA encoding the polypeptide of interest, whereby the mRNA is capable of being translated in the cell to produce the polypeptide.

In some embodiments, the disclosure provides a method of treating a disease or disorder in a mammal (e.g., a human) in need thereof. The method includes the step of administering to the mammal a therapeutically effective amount of a nanoparticle composition including (i) a lipid component including a phospholipid (such as a polyunsaturated lipid), a PEG lipid, a structural lipid, and a compound of Formula (I), (IA), (II), (IIa), (IIb), (IIc), (IId) or (IIe) and (ii) a therapeutic and/or prophylactic (e.g., an mRNA). In some embodiments, the disease or disorder is characterized by dysfunctional or aberrant protein or polypeptide activity. For example, the disease or disorder is selected from the group consisting of rare diseases, infectious diseases, cancer and proliferative diseases, genetic diseases (e.g., cystic fibrosis), autoimmune diseases, diabetes, neurodegenerative diseases, cardio- and reno-vascular diseases, and metabolic diseases.

In some embodiments, the disclosure provides a method of delivering (e.g., specifically delivering) a therapeutic and/or prophylactic to a mammalian organ (e.g., a liver, spleen, lung, or femur). This method includes the step of administering to a subject (e.g., a mammal) a nanoparticle composition including (i) a lipid component including a phospholipid, a PEG lipid, a structural lipid, and a compound of Formula (I), (IA), (II), (IIa), (IIb), (IIc), (IId) or (IIe) and (ii) a therapeutic and/or prophylactic (e.g., an mRNA), in which administering involves contacting the cell with the nanoparticle composition, whereby the therapeutic and/or prophylactic is delivered to the target organ (e.g., a liver, spleen, lung, or femur).

In some embodiments, the disclosure features a method for the enhanced delivery of a therapeutic and/or prophylactic (e.g., an mRNA) to a target tissue (e.g., a liver, spleen, lung, or femur). This method includes administering to a subject (e.g., a mammal) a nanoparticle composition, the composition including (i) a lipid component including a compound of Formula (I), (IA), (II), (IIa), (IIb), (IIc), (IId) or (IIe), a phospholipid, a structural lipid, and a PEG lipid; and (ii) a therapeutic and/or prophylactic, the administering including contacting the target tissue with the nanoparticle composition, whereby the therapeutic and/or prophylactic is delivered to the target tissue.

In some embodiments, the disclosure features a method of lowering immunogenicity comprising introducing the nanoparticle composition of the disclosure into cells, wherein the nanoparticle composition reduces the induction of the cellular immune response of the cells to the nanoparticle composition, as compared to the induction of the cellular immune response in cells induced by a reference composition which comprises a reference lipid instead of a compound of Formula (I), (IA), (II), (IIa), (IIb), (IIc), (IId) or (IIe). For example, the cellular immune response is an innate immune response, an adaptive immune response, or both.

The disclosure also includes methods of synthesizing a compound of Formula (I), (IA), (II), (IIa), (IIb), (IIc), (IId) or (IIe) and methods of making a nanoparticle composition including a lipid component comprising the compound of Formula (I), (IA), (II), (IIa), (IIb), (IIc), (IId) or (IIe).

Modes of Vaccine Administration

STD RNA (e.g. mRNA) vaccines may be administered by any route which results in a therapeutically effective outcome. These include, but are not limited to intradermal, intramuscular, intranasal and/or subcutaneous administration. The present disclosure provides methods comprising administering RNA (e.g., mRNA) vaccines to a subject in need thereof. The exact amount required will vary from subject to subject, depending on the species, age, and general condition of the subject, the severity of the disease, the particular composition, its mode of administration, its mode of activity, and the like. STD RNA (e.g., mRNA) vaccines compositions are typically formulated in dosage unit form for ease of administration and uniformity of dosage. It will be understood, however, that the total daily usage of RNA (e.g., mRNA) vaccine compositions may be decided by the attending physician within the scope of sound medical judgment. The specific therapeutically effective, prophylactically effective, or appropriate imaging dose level for any particular patient will depend upon a variety of factors including the disorder being treated and the severity of the disorder, the activity of the specific compound employed; the specific composition employed; the age, body weight, general health, sex and diet of the patient; the time of administration, route of administration, and rate of excretion of the specific compound employed; the duration of the treatment; drugs used in combination or coincidental with the specific compound employed; and like factors well known in the medical arts.

In some embodiments, STD RNA (e.g. mRNA) vaccines compositions may be administered at dosage levels sufficient to deliver 0.0001 mg/kg to 100 mg/kg, 0.001 mg/kg to 0.05 mg/kg, 0.005 mg/kg to 0.05 mg/kg, 0.001 mg/kg to 0.005 mg/kg, 0.05 mg/kg to 0.5 mg/kg, 0.01 mg/kg to 50 mg/kg, 0.1 mg/kg to 40 mg/kg, 0.5 mg/kg to 30 mg/kg, 0.01 mg/kg to 10 mg/kg, 0.1 mg/kg to 10 mg/kg, or 1 mg/kg to 25 mg/kg, of subject body weight per day, one or more times a day, per week, per month, etc. to obtain the desired therapeutic, diagnostic, prophylactic, or imaging effect (see, e.g., the range of unit doses described in International Publication No WO2013078199, the contents of which are herein incorporated by reference in their entirety). The desired dosage may be delivered three times a day, two times a day, once a day, every other day, every third day, every week, every two weeks, every three weeks, every four weeks, every 2 months, every three months, every 6 months, etc. In some embodiments, the desired dosage may be delivered using multiple administrations (e.g., two, three, four, five, six, seven, eight, nine, ten, eleven, twelve, thirteen, fourteen, or more administrations). When multiple administrations are employed, split dosing regimens such as those described herein may be used. In exemplary embodiments, STD RNA (e.g., mRNA) vaccines compositions may be administered at dosage levels sufficient to deliver 0.0005 mg/kg to 0.01 mg/kg, e.g., about 0.0005 mg/kg to about 0.0075 mg/kg, e.g., about 0.0005 mg/kg, about 0.001 mg/kg, about 0.002 mg/kg, about 0.003 mg/kg, about 0.004 mg/kg or about 0.005 mg/kg.

In some embodiments, STD RNA (e.g., mRNA) vaccine compositions may be administered once or twice (or more) at dosage levels sufficient to deliver 0.025 mg/kg to 0.250 mg/kg, 0.025 mg/kg to 0.500 mg/kg, 0.025 mg/kg to 0.750 mg/kg, or 0.025 mg/kg to 1.0 mg/kg.

In some embodiments, STD RNA (e.g., mRNA) vaccine compositions may be administered twice (e.g., Day 0 and Day 7, Day 0 and Day 14, Day 0 and Day 21, Day 0 and Day 28, Day 0 and Day 60, Day 0 and Day 90, Day 0 and Day 120, Day 0 and Day 150, Day 0 and Day 180, Day 0 and 3 months later, Day 0 and 6 months later, Day 0 and 9 months later. Day 0 and 12 months later, Day 0 and 18 months later, Day 0 and 2 years later, Day 0 and 5 years later, or Day 0 and 10 years later) at a total dose of or at dosage levels sufficient to deliver a total dose of 0.0100 mg, 0.025 mg, 0.050 mg, 0.075 mg, 0.100 mg, 0.125 mg, 0.150 mg, 0.175 mg, 0.200 mg, 0.225 mg, 0.250 mg, 0.275 mg, 0.300 mg, 0.325 mg, 0.350 mg, 0.375 mg, 0.400 mg, 0.425 mg, 0.450 mg, 0.475 mg, 0.500 mg, 0.525 mg, 0.550 mg, 0.575 mg, 0.600 mg, 0.625 mg, 0.650 mg, 0.675 mg, 0.700 mg, 0.725 mg, 0.750 mg, 0.775 mg, 0.800 mg, 0.825 mg, 0.850 mg, 0.875 mg, 0.900 mg, 0.925 mg, 0.950 mg, 0.975 mg, or 1.0 mg. Higher and lower dosages and frequency of administration are encompassed by the present disclosure. For example, a STD RNA (e.g., mRNA) vaccine composition may be administered three or four times.

In some embodiments, STD RNA (e.g., mRNA) vaccine compositions may be administered twice (e.g., Day 0 and Day 7, Day 0 and Day 14, Day 0 and Day 21, Day 0 and Day 28, Day 0 and Day 60, Day 0 and Day 90, Day 0 and Day 120, Day 0 and Day 150, Day 0 and Day 180, Day 0 and 3 months later, Day 0 and 6 months later, Day 0 and 9 months later. Day 0 and 12 months later, Day 0 and 18 months later, Day 0 and 2 years later, Day 0 and 5 years later, or Day 0 and 10 years later) at a total dose of or at dosage levels sufficient to deliver a total dose of 0.010 mg, 0.025 mg, 0.100 mg or 0.400 mg.

In some embodiments, the STD RNA (e.g., mRNA) vaccine for use in a method of vaccinating a subject is administered to the subject as a single dosage of between 10 µg/kg and 400 µg/kg of the nucleic acid vaccine (in an effective amount to vaccinate the subject). In some embodiments the RNA (e.g., mRNA) vaccine for use in a method of vaccinating a subject is administered to the subject as a single dosage of between 10 µg and 400 µg of the nucleic acid vaccine (in an effective amount to vaccinate the subject). In some embodiments, a STD RNA (e.g., mRNA) vaccine for use in a method of vaccinating a subject is administered to the subject as a single dosage of 25-1000 µg (e.g., a single dosage of mRNA encoding HPV, HSV and/or *Chlamydia* antigen). In some embodiments, a STD RNA (e.g., mRNA) vaccine is administered to the subject as a single dosage of 25, 50, 100, 150, 200, 250, 300, 350, 400, 450, 500, 550, 600, 650, 700, 750, 800, 850, 900, 950 or 1000 µg. For example, a STD RNA (e.g., mRNA) vaccine may be administered to a subject as a single dose of 25-100, 25-500, 50-100, 50-500, 50-1000, 100-500, 100-1000, 250-500, 250-1000, or 500-1000 µg. In some embodiments, a STD RNA (e.g., mRNA) vaccine for use in a method of vaccinating a subject is administered to the subject as two dosages, the combination of which equals 25-1000 µg of the STD RNA (e.g., mRNA) vaccine.

A STD RNA (e.g. mRNA) vaccine pharmaceutical composition described herein can be formulated into a dosage form described herein, such as an intranasal, intratracheal, or injectable (e.g., intravenous, intraocular, intravitreal, intramuscular, intradermal, intracardiac, intraperitoneal, intranasal and subcutaneous).

STD RNA (e.g., mRNA) Vaccine Formulations and Methods of Use

Some aspects of the present disclosure provide formulations of the STD RNA (e.g., mRNA) vaccine, wherein the RNA (e.g., mRNA) vaccine is formulated in an effective amount to produce an antigen specific immune response in a subject (e.g., production of antibodies specific to an HPV, HSV and/or *Chlamydia* antigenic polypeptide). "An effective amount" is a dose of an RNA (e.g., mRNA) vaccine effective to produce an antigen-specific immune response. Also provided herein are methods of inducing an antigen-specific immune response in a subject.

In some embodiments, the antigen-specific immune response is characterized by measuring an anti-HPV, anti-HSV and/or anti-*Chlamydia* antigenic polypeptide antibody titer produced in a subject administered a STD RNA (e.g., mRNA) vaccine as provided herein. An antibody titer is a measurement of the amount of antibodies within a subject, for example, antibodies that are specific to a particular antigen (e.g., an anti-HPV, anti-HSV and/or anti-*Chlamydia* antigenic polypeptide) or epitope of an antigen. Antibody titer is typically expressed as the inverse of the greatest dilution that provides a positive result. Enzyme-linked immunosorbent assay (ELISA) is a common assay for determining antibody titers, for example.

In some embodiments, an antibody titer is used to assess whether a subject has had an infection or to determine whether immunizations are required. In some embodiments, an antibody titer is used to determine the strength of an autoimmune response, to determine whether a booster immunization is needed, to determine whether a previous vaccine was effective, and to identify any recent or prior infections. In accordance with the present disclosure, an antibody titer may be used to determine the strength of an immune response induced in a subject by the STD RNA (e.g., mRNA) vaccine.

In some embodiments, an anti-antigenic polypeptide (e.g., an anti-HPV, HSV and/or *Chlamydia* antigenic polypeptide) antibody titer produced in a subject is increased by at least 1 log relative to a control. For example, anti-antigenic polypeptide antibody titer produced in a subject may be increased by at least 1.5, at least 2, at least 2.5, or at least 3 log relative to a control. In some embodiments, the anti-antigenic polypeptide antibody titer produced in the subject is increased by 1, 1.5, 2, 2.5 or 3 log relative to a control. In some embodiments, the anti-antigenic polypeptide antibody titer produced in the subject is increased by 1-3 log relative to a control. For example, the anti-antigenic polypeptide antibody titer produced in a subject may be increased by 1-1.5, 1-2, 1-2.5, 1-3, 1.5-2, 1.5-2.5, 1.5-3, 2-2.5, 2-3, or 2.5-3 log relative to a control.

In some embodiments, the anti-antigenic polypeptide (e.g., an anti-HPV, HSV and/or *Chlamydia* antigenic polypeptide) antibody titer produced in a subject is increased at least 2 times relative to a control. For example, the anti-antigenic polypeptide antibody titer produced in a subject may be increased at least 3 times, at least 4 times, at least 5 times, at least 6 times, at least 7 times, at least 8 times, at least 9 times, or at least 10 times relative to a control. In some embodiments, the anti-antigenic polypeptide antibody titer produced in the subject is increased 2, 3, 4, 5, 6, 7, 8, 9, or 10 times relative to a control. In some embodiments, the anti-antigenic polypeptide antibody titer produced in a subject is increased 2-10 times relative to a control. For example, the anti-antigenic polypeptide antibody titer produced in a subject may be increased 2-10, 2-9, 2-8, 2-7, 2-6, 2-5, 2-4, 2-3, 3-10, 3-9, 3-8, 3-7, 3-6, 3-5, 3-4, 4-10, 4-9, 4-8, 4-7, 4-6, 4-5, 5-10, 5-9, 5-8, 5-7, 5-6, 6-10, 6-9, 6-8, 6-7, 7-10, 7-9, 7-8, 8-10, 8-9, or 9-10 times relative to a control.

A control, in some embodiments, is the anti-antigenic polypeptide (e.g., an anti-HPV, HSV and/or *Chlamydia* antigenic polypeptide) antibody titer produced in a subject who has not been administered a STD RNA (e.g., mRNA) vaccine of the present disclosure. In some embodiments, a control is an anti-antigenic polypeptide (e.g., an anti-HPV, HSV and/or *Chlamydia* antigenic polypeptide) antibody titer produced in a subject who has been administered a live attenuated HPV, HSV and/or *Chlamydia* vaccine. An attenuated vaccine is a vaccine produced by reducing the virulence of a viable (live). An attenuated virus is altered in a manner that renders it harmless or less virulent relative to live, unmodified virus. In some embodiments, a control is an anti-antigenic polypeptide (e.g., an anti-HPV, HSV and/or *Chlamydia* antigenic polypeptide) antibody titer produced in a subject administered inactivated HPV, HSV and/or *Chlamydia* vaccine. In some embodiments, a control is an anti-antigenic polypeptide (e.g., an anti-HPV, HSV and/or *Chlamydia* antigenic polypeptide) antibody titer produced in a subject administered a recombinant or purified HPV, HSV and/or *Chlamydia* protein vaccine. Recombinant protein vaccines typically include protein antigens that either have been produced in a heterologous expression system (e.g., bacteria or yeast) or purified from large amounts of the pathogenic organism. In some embodiments, a control is an anti-antigenic polypeptide (e.g., an anti-HPV, HSV and/or *Chlamydia* antigenic polypeptide) antibody titer produced in a subject who has been administered an HPV, HSV and/or *Chlamydia* virus-like particle (VLP) vaccine.

In some embodiments, an effective amount of a STD RNA (e.g., mRNA) vaccine is a dose that is reduced compared to the standard of care dose of a recombinant HPV, HSV and/or *Chlamydia* protein vaccine. A "standard of care," as provided herein, refers to a medical or psychological treatment guideline and can be general or specific. "Standard of care" specifies appropriate treatment based on scientific evidence and collaboration between medical professionals involved in the treatment of a given condition. It is the diagnostic and treatment process that a physician/clinician should follow for a certain type of patient, illness or clinical circumstance. A "standard of care dose," as provided herein, refers to the dose of a recombinant or purified HPV, HSV and/or *Chlamydia* protein vaccine, or a live attenuated or inactivated HPV, HSV and/or *Chlamydia* vaccine, that a physician/clinician or other medical professional would administer to a subject to treat or prevent HPV, HSV and/or *Chlamydia*, or a related condition, while following the standard of care guideline for treating or preventing HPV, HSV and/or *Chlamydia*, or a related condition.

In some embodiments, the anti-antigenic polypeptide (e.g., an anti-HPV, anti-HSV and/or anti *Chlamydia* antigenic polypeptide) antibody titer produced in a subject administered an effective amount of a STD RNA (e.g., mRNA) vaccine is equivalent to an anti-antigenic polypeptide (e.g., an anti-HPV, anti-HSV and/or anti *Chlamydia* antigenic polypeptide) antibody titer produced in a control subject administered a standard of care dose of a recombinant or purified HPV, HSV and/or *Chlamydia* protein vaccine or a live attenuated or inactivated HPV, HSV and/or *Chlamydia* vaccine.

In some embodiments, an effective amount of a STD RNA (e.g., mRNA) vaccine is a dose equivalent to an at least 2-fold reduction in a standard of care dose of a recombinant or purified HPV, HSV and/or *Chlamydia* protein vaccine. For example, an effective amount of a STD RNA (e.g., mRNA) vaccine may be a dose equivalent to an at least 3-fold, at least 4-fold, at least 5-fold, at least 6-fold, at least 7-fold, at least 8-fold, at least 9-fold, or at least 10-fold reduction in a standard of care dose of a recombinant or purified HPV, HSV and/or *Chlamydia* protein vaccine. In some embodiments, an effective amount of a STD RNA (e.g., mRNA) vaccine is a dose equivalent to an at least at least 100-fold, at least 500-fold, or at least 1000-fold reduction in a standard of care dose of a recombinant or purified HPV, HSV and/or *Chlamydia* protein vaccine. In some embodiments, an effective amount of a STD RNA (e.g., mRNA) vaccine is a dose equivalent to a 2-, 3-, 4-, 5-, 6-, 7-, 8-, 9-, 10-, 20-, 50-, 100-, 250-, 500-, or 1000-fold reduction in a standard of care dose of a recombinant or purified HPV, HSV and/or *Chlamydia* protein vaccine. In some embodiments, the anti-antigenic polypeptide antibody titer produced in a subject administered an effective amount of a STD RNA (e.g., mRNA) vaccine is equivalent to an anti-antigenic polypeptide antibody titer produced in a control subject administered the standard of care dose of a recombinant or protein HPV, HSV and/or *Chlamydia* protein vaccine or a live attenuated or inactivated HPV, HSV and/or *Chlamydia* vaccine. In some embodiments, an effective amount of a STD RNA (e.g., mRNA) vaccine is a dose equivalent to a 2-fold to 1000-fold (e.g., 2-fold to 100-fold, 10-fold to 1000-fold) reduction in the standard of care dose of a recombinant or purified HPV, HSV and/or *Chlamydia* protein vaccine, wherein the anti-antigenic polypeptide antibody titer produced in the subject is equivalent to an anti-antigenic polypeptide antibody titer produced in a control subject administered the standard of care dose of a recombinant or purified HPV, HSV and/or *Chlamydia* protein vaccine or a live attenuated or inactivated HPV, HSV and/or *Chlamydia* vaccine.

In some embodiments, the effective amount of a STD RNA (e.g., mRNA) vaccine is a dose equivalent to a 2 to 100-, 2 to 900-, 2 to 800-, 2 to 700-, 2 to 600-, 2 to 500-, 2 to 400-, 2 to 300-, 2 to 200-, 2 to 100-, 2 to 90-, 2 to 80-, 2 to 70-, 2 to 60-, 2 to 50-, 2 to 40-, 2 to 30-, 2 to 20-, 2 to 10-, 2 to 9-, 2 to 8-, 2 to 7-, 2 to 6-, 2 to 5-, 2 to 4-, 2 to 3-, 3 to 1000-, 3 to 900-, 3 to 800-, 3 to 700-, 3 to 600-, 3 to 500-, 3 to 400-, 3 to 3 to 00-, 3 to 200-, 3 to 100-, 3 to 90-, 3 to 80-, 3 to 70-, 3 to 60-, 3 to 50-, 3 to 40-, 3 to 30-, 3 to 20-, 3 to 10-, 3 to 9-, 3 to 8-, 3 to 7-, 3 to 6-, 3 to 5-, 3 to 4-, 4 to 1000-, 4 to 900-, 4 to 800-, 4 to 700-, 4 to 600-, 4 to 500-, 4 to 400-, 4 to 4 to 00-, 4 to 200-, 4 to 100-, 4 to 90-, 4 to 80-, 4 to 70-, 4 to 60-, 4 to 50-, 4 to 40-, 4 to 30-, 4 to 20-, 4 to 10-, 4 to 9-, 4 to 8-, 4 to 7-, 4 to 6-, 4 to 5-, 4 to 4-, 5 to 1000-, 5 to 900-, 5 to 800-, 5 to 700-, 5 to 600-, 5 to 500-, 5 to 400-, 5 to 300-, 5 to 200-, 5 to 100-, 5 to 90-, 5 to 80-, 5 to 70-, 5 to 60-, 5 to 50-, 5 to 40-, 5 to 30-, 5 to 20-, 5 to 10-, 5 to 9-, 5 to 8-, 5 to 7-, 5 to 6-, 6 to 1000-, 6 to 900-, 6 to 800-, 6 to 700-, 6 to 600-, 6 to 500-, 6 to 400-, 6 to 300-, 6 to 200-, 6 to 100-, 6 to 90-, 6 to 80-, 6 to 70-, 6 to 60-, 6 to 50-, 6 to 40-, 6 to 30-, 6 to 20-, 6 to 10-, 6 to 9-, 6 to 8-, 6 to 7-, 7 to 1000-, 7 to 900-, 7 to 800-, 7 to 700-, 7 to 600-, 7 to 500-, 7 to 400-, 7 to 300-, 7 to 200-, 7 to 100-, 7 to 90-, 7 to 80-, 7 to 70-, 7 to 60-, 7 to 50-, 7 to 40-, 7 to 30-, 7 to 20-, 7 to 10-, 7 to 9-, 7 to 8-, 8 to 1000-, 8 to 900-, 8 to 800-, 8 to 700-, 8 to 600-, 8 to 500-, 8 to 400-, 8 to 300-, 8 to 200-, 8 to 100-, 8 to 90-, 8 to 80-, 8 to 70-, 8 to 60-, 8 to 50-, 8 to 40-, 8 to 30-, 8 to 20-, 8 to 10-, 8 to 9-, 9 to 1000-, 9 to 900-, 9 to 800-, 9 to 700-, 9 to 600-, 9 to 500-, 9 to 400-, 9 to 300-, 9 to 200-, 9 to 100-, 9 to 90-, 9 to 80-, 9 to 70-, 9 to 60-, 9 to 50-, 9 to 40-, 9 to 30-, 9 to 20-, 9 to 10-, 10 to 1000-, 10 to 900-, 10 to 800-, 10 to 700-, 10 to 600-, 10 to 500-, 10 to 400-, 10 to 300-, 10 to 200-, 10 to 100-, 10 to 90-, 10 to 80-, 10 to 70-, 10 to 60-, 10 to 50-, 10 to 40-, 10 to 30-, 10 to 20-, 20 to 1000-, 20 to 900-, 20 to 800-, 20 to 700-, 20 to 600-, 20 to 500-, 20 to 400-, 20 to 300-, 20 to 200-, 20 to 100-, 20 to 90-, 20 to 80-, 20 to 70-, 20 to 60-, 20 to 50-, 20 to 40-, 20 to 30-, 30 to 1000-, 30 to 900-, 30 to 800-, 30 to 700-, 30 to 600-, 30 to 500-, 30 to 400-, 30 to 300-, 30 to 200-, 30 to 100-, 30 to 90-, 30 to 80-, 30 to 70-, 30 to 60-, 30 to 50-, 30 to 40-, 40 to 1000-, 40 to 900-, 40 to 800-, 40 to 700-, 40 to 600-, 40 to 500-, 40 to 400-, 40 to 300-, 40 to 200-, 40 to 100-, 40 to 90-, 40 to 80-, 40 to 70-, 40 to 60-, 40 to 50-, 50 to 1000-, 50 to 900-, 50 to 800-, 50 to 700-, 50 to 600-, 50 to 500-, 50 to 400-, 50 to 300-, 50 to 200-, 50 to 100-, 50 to 90-, 50 to 80-, 50 to 70-, 50 to 60-, 60 to 1000-, 60 to 900-, 60 to 800-, 60 to 700-, 60 to 600-, 60 to 500-, 60 to 400-, 60 to 300-, 60 to 200-, 60 to 100-, 60 to 90-, 60 to 80-, 60 to 70-, 70 to 1000-, 70 to 900-, 70 to 800-, 70 to 700-, 70 to 600-, 70 to 500-, 70 to 400-, 70 to 300-, 70 to 200-, 70 to 100-, 70 to 90-, 70 to 80-, 80 to 1000-, 80 to 900-, 80 to 800-, 80 to 700-, 80 to 600-, 80 to 500-, 80 to 400-, 80 to 300-, 80 to 200-, 80 to 100-, 80 to 90-, 90 to 1000-, 90 to 900-, 90 to 800-, 90 to 700-, 90 to 600-, 90 to 500-, 90 to 400-, 90 to 300-, 90 to 200-, 90 to 100-, 100 to 100-, 100 to 900-, 100 to 800-, 100 to 700-, 100 to 600, 100 to 500, 100 to 400-, 100 to 300-, 100 to 200-, 200 to 1000-, 200 to 900-, 200 to 800-, 200 to 700-, 200 to 600-, 200 to 500-, 200 to 400-, 200 to 300-, 300 to 1000-, 300 to 900-, 300 to 800-, 300 to 700-, 300 to 600-, 300 to 500-, 300 to 400-, 400 to 1000-, 400 to 900-, 400 to 800-, 400 to 700-, 400 to 600-, 400 to 500-, 500 to 1000-, 500 to 900-, 500 to 800-, 500 to 700-, 500 to 600-, 600 to 1000-, 600 to 900-, 600 to 800-, 600 to 700-, 700 to 1000-, 700 to 900-, 700 to 800-, 800 to 1000-, 800 to 900-, or 900 to 1000-fold reduction in the standard of care dose of a recombinant HPV, HSV and/or *Chlamydia* protein vaccine. In some embodiments, the anti-antigenic polypeptide antibody titer produced in the subject is equivalent to an anti-antigenic polypeptide antibody titer produced in a control subject administered the standard of care dose of a recombinant or purified HPV, HSV and/or *Chlamydia* protein vaccine or a live attenuated or inactivated HPV, HSV and/or *Chlamydia* vaccine. In some embodiments, the effective amount is a dose equivalent to (or equivalent to an at least) 2-, 3-, 4-, 5-, 6-, 7-, 8-, 9-, 10-, 20-, 30-, 40-, 50-, 60-, 70-, 80-, 90-, 100-, 110-, 120-, 130-, 140-, 150-, 160-, 170-, 1280-, 190-, 200-, 210-, 220-, 230-, 240-, 250-, 260-, 270-, 280-, 290-, 300-, 310-, 320-, 330-, 340-, 350-, 360-, 370-, 380-, 390-, 400-, 410-, 420-, 430-, 440-, 450-, 4360-, 470-, 480-, 490-, 500-, 510-, 520-, 530-, 540-, 550-, 560-, 5760-, 580-, 590-, 600-, 610-, 620-, 630-, 640-, 650-, 660-, 670-, 680-, 690-, 700-, 710-, 720-, 730-, 740-, 750-, 760-, 770-, 780-, 790-, 800-, 810-, 820-, 830-, 840-, 850-, 860-, 870-, 880-, 890-, 900-, 910-, 920-, 930-, 940-, 950-, 960-, 970-, 980-, 990-, or 1000-fold reduction in the standard of care dose of a recombinant HPV, HSV and/or *Chlamydia* protein vaccine. In some embodiments, an anti-antigenic polypeptide antibody titer produced in the subject is equivalent to an anti-antigenic polypeptide antibody titer produced in a control subject administered the standard of care dose of a recombinant or purified HPV, HSV and/or *Chlamydia* protein vaccine or a live attenuated or inactivated HPV, HSV and/or *Chlamydia* vaccine.

In some embodiments, the effective amount of a STD RNA (e.g., mRNA) vaccine is a total dose of 50-1000 µg. In some embodiments, the effective amount of a STD RNA (e.g., mRNA) vaccine is a total dose of 50-1000, 50-900, 50-800, 50-700, 50-600, 50-500, 50-400, 50-300, 50-200, 50-100, 50-90, 50-80, 50-70, 50-60, 60-1000, 60-900, 60-800, 60-700, 60-600, 60-500, 60-400, 60-300, 60-200, 60-100, 60-90, 60-80, 60-70, 70-1000, 70-900, 70-800, 70-700, 70-600, 70-500, 70-400, 70-300, 70-200, 70-100, 70-90, 70-80, 80-1000, 80-900, 80-800, 80-700, 80-600, 80-500, 80-400, 80-300, 80-200, 80-100, 80-90, 90-1000, 90-900, 90-800, 90-700, 90-600, 90-500, 90-400, 90-300, 90-200, 90-100, 100-1000, 100-900, 100-800, 100-700, 100-600, 100-500, 100-400, 100-300, 1000-200, 200-1000, 200-900, 200-800, 200-700, 200-600, 200-500, 200-400, 200-300, 300-1000, 300-900, 300-800, 300-700, 300-600, 300-500, 300-400, 400-1000, 400-900, 400-800, 400-700, 400-600, 400-500, 500-1000, 500-900, 500-800, 500-700, 500-600), 600-1000, 600-900, 600-900, 600-700, 700-1000, 700-900, 700-800, 800-1000), 800-900, or 900-10000 µg. In some embodiments, the effective amount of a STD RNA (e.g., mRNA) vaccine is a total dose of 50, 100, 150, 200, 250, 300, 350, 400, 450, 500, 550, 600, 650, 700, 750, 800, 850, 900, 950 or 1000 µg. In some embodiments, the effective amount is a dose of 25-500 µg administered to the subject a total of two times. In some embodiments, the effective amount of a STD RNA (e.g., mRNA) vaccine is a dose of 25-500, 25-400, 25-300, 25-200, 25-100, 25-50, 50-500, 50-400, 50-300, 50-200, 50-100, 100-500, 100-400, 100-300, 100-200, 150-500, 150-400, 150-300, 150-200, 200-500, 200-400, 200-300, 250-500, 250-400, 250-300, 300-500, 300-400, 350-500), 350-400, 400-500 or 450-500 µg administered to the subject a total of two times. In some embodiments, the effective amount of a STD RNA (e.g., mRNA) vaccine is a total dose of 25, 50, 100, 150, 200, 250, 300, 350, 400, 450, or 500 µg administered to a subject a total of two times.

ADDITIONAL EMBODIMENTS

1. A sexually transmitted disease (STD) vaccine, comprising:
at least one RNA polynucleotide having an open reading frame encoding at least one human papillomavirus (HPV) antigenic polypeptide and at least one herpes simplex virus (HSV) antigenic polypeptide, optionally formulated in a cationic lipid nanoparticle having a molar ratio of about 20-60% cationic lipid, about 5-25% non-cationic lipid, about 25-55% sterol, and about 0.5-15% PEG-modified lipid, optionally wherein the at least one RNA polynucleotide comprises at least one chemical modification.

2. A sexually transmitted disease (STD) vaccine, comprising:
at least one RNA polynucleotide having an open reading frame encoding at least one human papillomavirus (HPV) antigenic polypeptide and at least one *Chlamydia trachomatis* antigenic polypeptide, optionally formulated in a cationic lipid nanoparticle having a molar ratio of about 20-60% cationic lipid, about 5-25% non-cationic lipid, about 25-55% sterol, and about 0.5-15% PEG-modified lipid, optionally wherein the at least one RNA polynucleotide comprises at least one chemical modification.

3. A sexually transmitted disease (STD) vaccine, comprising:
at least one RNA polynucleotide having an open reading frame encoding at least one herpes simplex virus (HSV) antigenic polypeptide and at least one *Chlamydia trachomatis* antigenic polypeptide, optionally formulated in a cationic lipid nanoparticle having a molar ratio of about 20-60% cationic lipid, about 5-25% non-cationic lipid, about 25-55% sterol, and about 0.5-15% PEG-modified lipid, optionally wherein the at least one RNA polynucleotide comprises at least one chemical modification.

4. The vaccine of paragraph 1 or 2, wherein the at least one antigenic polypeptide is selected from HPV E1 protein, HPV E2 protein, HPV E4 protein, HPV E5 protein, HPV E6 protein, HPV E7 protein, HPV L1 protein, and HPV L2 protein, optionally wherein the HPV serotype is selected from HPV serotypes 6, 11, 16, 18, 31, 33, 35, 39, 45, 51, 52, 56, 58, 59, 68, 73 and 82.

5. The vaccine of paragraph 1, 2 or 4, wherein the vaccine comprises at least one RNA polynucleotide having an open reading frame encoding at least two antigenic polypeptides or immunogenic fragments thereof selected from HPV E1 protein, HPV E2 protein, HPV E4 protein, HPV E5 protein, HPV E6 protein, HPV E7 protein, HPV L1 protein, and HPV L2 protein.

6. The vaccine of paragraph 1, 2, 4 or 5, wherein the vaccine comprises at least two RNA polynucleotides, each having an open reading frame encoding at least one antigenic polypeptide or an immunogenic fragment thereof selected from HPV E1 protein, HPV E2 protein, HPV E4 protein, HPV E5 protein, HPV E6 protein, HPV E7 protein, HPV L1 protein, and HPV L2 protein, wherein the HPV antigenic polypeptide encoded by one of the open reading frames differs from the HPV antigenic polypeptide encoded by another of the open reading frames.

7. The vaccine of any one of paragraphs 1, 2 or 4-6, wherein the at least one antigenic polypeptide comprises an amino acid sequence identified by any one of SEQ ID NO: 31-61.

8. The vaccine of any one of paragraphs 1, 2 or 4-7, wherein the at least one RNA polypeptide is encoded by a nucleic acid sequence identified by any one of SEQ ID NO: 1-30, and/or wherein the at least one RNA polypeptide comprises a nucleic acid sequence identified by any one of SEQ ID NO: 431-461.

9. The vaccine of any one of paragraphs 1, 2 or 4-8, wherein the at least one antigenic polypeptide has an amino acid sequence that has at least 95% identity to an amino acid sequence identified by any one of SEQ ID NO: 31-61.

10. The vaccine of any one of paragraphs 1, 2 or 4-9, wherein the at least one antigenic polypeptide has an amino acid sequence that has 95%-99% identity to an amino acid sequence identified by any one of SEQ ID NO: 31-61.

11. The vaccine of any one of paragraphs 1, 2 or 4-10, wherein the at least one antigenic polypeptide has an amino acid sequence that has at least 90% identity to an amino acid sequence of SEQ ID NO: 31-61 and wherein the antigenic polypeptide or immunogenic fragment thereof has membrane fusion activity, attaches to cell receptors, causes fusion of viral and cellular membranes, and/or is responsible for binding of the virus to a cell being infected.

12. The vaccine of any one of paragraphs 1, 2 or 4-11, wherein the at least one antigenic polypeptide has an amino acid sequence that has 90%-99% identity to an amino acid sequence of SEQ ID NO: 31-61 and wherein the antigenic polypeptide or immunogenic fragment thereof has membrane fusion activity, attaches to cell receptors, causes fusion of viral and cellular membranes, and/or is responsible for binding of the virus to a cell being infected.

13. The vaccine of any one of paragraphs 2-12, wherein the at least one antigenic polypeptide is a major outer membrane protein (MOMP) or an immunogenic fragment thereof, optionally having a Chlamydia trachomatis serovar selected serovar H, F, E, D, I, G, J and K.

14. The vaccine of any one of paragraphs 2-13, wherein the vaccine comprises at least one RNA polynucleotide having an open reading frame encoding at least two antigenic polypeptides or immunogenic fragments thereof selected from a MOMP of serovar H, a MOMP of serovar F, a MOMP of serovar E, a MOMP of serovar D, a MOMP of serovar I, a MOMP of serovar G, a MOMP of serovar J, and a MOMP of serovar K.

15. The vaccine of any one of paragraphs 2-14, wherein the vaccine comprises at least two RNA polynucleotides, each having an open reading frame encoding at least one antigenic polypeptide or an immunogenic fragment thereof selected from a MOMP of serovar H, a MOMP of serovar F, a MOMP of serovar E, a MOMP of serovar D, a MOMP of serovar I, a MOMP of serovar G, a MOMP of serovar J, and a MOMP of serovar K, wherein the antigenic polypeptide encoded by one of the open reading frames differs from the antigenic polypeptide encoded by another of the open reading frames.

16. The vaccine of any one of paragraphs 2-15, wherein the at least one antigenic polypeptide comprises an amino acid sequence identified by any one of SEQ ID NO: 65-183.

17. The vaccine of any one of paragraphs 2-16, wherein the at least one RNA polypeptide is encoded by a nucleic acid sequence identified by any one of SEQ ID NO: 62-64 or 184-294, and/or wherein the at least one RNA polypeptide comprises a nucleic acid sequence identified by any one of SEQ ID NO: 317-430.

18. The vaccine of any one of paragraphs 2-17, wherein the at least one antigenic polypeptide has an amino acid sequence that has at least 95% identity to an amino acid sequence identified by any one of SEQ ID NO: 65-183.

19. The vaccine of any one of paragraphs 2-18, wherein the at least one antigenic polypeptide has an amino acid sequence that has 95%-99% identity to an amino acid sequence identified by any one of SEQ ID NO: 65-183.

20. The vaccine of any one of paragraphs 2-19, wherein the at least one antigenic polypeptide has an amino acid sequence that has at least 90% identity to an amino acid sequence of SEQ ID NO: 65-183 and wherein the antigenic polypeptide or immunogenic fragment thereof has membrane fusion activity, attaches to cell receptors, causes fusion of viral and cellular membranes, and/or is responsible for binding of the virus to a cell being infected.

21. The vaccine of any one of paragraphs 2-20, wherein the at least one antigenic polypeptide has an amino acid sequence that has 0.90%-99% identity to an amino acid sequence of SEQ ID NO: 65-183 and wherein the antigenic polypeptide or immunogenic fragment thereof has membrane fusion activity, attaches to cell receptors, causes fusion of viral and cellular membranes, and/or is responsible for binding of the virus to a cell being infected.

22 The vaccine of any one of paragraphs 1-21, wherein the at least one RNA polynucleotide has less than 80% identity to wild-type mRNA sequence.

23. The vaccine of any one of paragraphs 1-21, wherein at least one RNA polynucleotide has at least 80% identity to wild-type mRNA sequence, but does not include wild-type mRNA sequence.

24. The vaccine of any one of paragraphs 1-23, wherein the at least one antigenic polypeptide has membrane fusion activity, attaches to cell receptors, causes fusion of viral and cellular membranes, and/or is responsible for binding of the virus to a cell being infected.

25. The vaccine of any one of paragraphs 1-24, wherein the at least one RNA polynucleotide comprises at least one chemical modification.

26. The vaccine of paragraph 1-25, wherein the chemical modification is selected from pseudouridine, N1-methylpseudouridine, N1-ethylpseudouridine, 2-thiouridine, 4'-thiouridine, 5-methylcytosine, 5-methyluridine, 2-thio-1-methyl-1-deaza-pseudouridine, 2-thio-1-methyl-pseudouridine, 2-thio-5-aza-uridine, 2-thio-dihydropseudouridine, 2-thio-dihydrouridine, 2-thio-pseudouridine, 4-methoxy-2-thio-pseudouridine, 4-methoxy-pseudouridine, 4-thio-1-methyl-pseudouridine, 4-thio-pseudouridine, 5-aza-uridine, dihydropseudouridine, 5-methoxyuridine and 2'-O-methyl uridine.

27. The vaccine of paragraph 1-26, wherein the chemical modification is in the 5-position of the uracil.

28. The vaccine of any one of paragraphs 1-27, wherein the chemical modification is a N1-methylpseudouridine or N1-ethylpseudouridine.

29. The vaccine of any one of paragraphs 1-28, wherein at least 80% of the uracil in the open reading frame have a chemical modification.

30. The vaccine of any one of paragraphs 1-29, wherein at least 90% of the uracil in the open reading frame have a chemical modification.

31. The vaccine of any one of paragraphs 1-30, wherein 100% of the uracil in the open reading frame have a chemical modification.

32. The vaccine of any one of paragraphs 1-31, wherein at least one RNA polynucleotide further encodes at least one 5' terminal cap.

33. The vaccine of paragraph 32, wherein the 5' terminal cap is 7mG(5')ppp(5')NlmpNp.

34. The vaccine of any one of paragraphs 1-33, wherein at least one antigenic polypeptide or immunogenic fragment thereof is fused to a signal peptide selected from: a HuIgGk signal peptide (METPAQLLFLLLLWLPDTTG; SEQ ID NO: 304); IgE heavy chain epsilon-1 signal peptide (MDWTWILFLVAAATRVHS; SEQ ID NO: 305); Japanese encephalitis PRM signal sequence (MLGSNSGQRV-VFTILLLLVAPAYS; SEQ ID NO: 306), VSVg protein signal sequence (MKCLLYLAFLFIGVNCA; SEQ ID NO: 307) and Japanese encephalitis JEV signal sequence (MWLVSLAIVTACAGA; SEQ ID NO: 308).

35. The vaccine of paragraph 34, wherein the signal peptide is fused to the N-terminus of at least one antigenic polypeptide.

36. The vaccine of paragraph 34, wherein the signal peptide is fused to the C-terminus of at least one antigenic polypeptide.

37. The vaccine of any one of paragraphs 1-36, wherein the antigenic polypeptide or immunogenic fragment thereof comprises a mutated N-linked glycosylation site.

38. The vaccine of any one of paragraphs 1-37, formulated in a nanoparticle.

39. The vaccine of paragraph 38, wherein the nanoparticle is a lipid nanoparticle.
40. The vaccine of any one of paragraphs 1-39, wherein the nanoparticle has a mean diameter of 50-200 nm.
41. The vaccine of any one of paragraphs 1-40, wherein the lipid nanoparticle comprises a cationic lipid, a PEG-modified lipid, a sterol and a non-cationic lipid.
42. The vaccine of paragraph 41, wherein the lipid nanoparticle carrier comprises a molar ratio of about 20-60% cationic lipid, 0.5-15% PEG-modified lipid, 25-55% sterol, and 25% non-cationic lipid.
43. The vaccine of paragraph 41 or 42, wherein the cationic lipid is an ionizable cationic lipid and the non-cationic lipid is a neutral lipid, and the sterol is a cholesterol.
44. The vaccine of any one of paragraphs 41-43, wherein the cationic lipid is selected from 2,2-dilinoleyl-4-dimethylaminoethyl-[1,3]-dioxolane (DLin-KC2-DMA), dilinoleylmethyl-4-dimethylaminobutyrate (DLin-MC3-DMA), and di((Z)-non-2-en-1-yl) 9-((4-(dimethylamino)butanoyl)oxy) heptadecanedioate (L319).
45. The vaccine of any one of paragraphs 1-44, wherein the lipid nanoparticle comprises a compound of Formula (I), optionally Compound 3, 18, 20, 25, 26, 29, 30, 60, 108-112, or 122.
46. The vaccine of any one of paragraphs 1-45, wherein the lipid nanoparticle comprises a compound of Formula (II).
47. The vaccine of any one of paragraphs 1-46, wherein the nanoparticle has a polydispersity value of less than 0.4.
48. The vaccine of any one of paragraphs 1-47, wherein the nanoparticle has a net neutral charge at a neutral pH value.
49. The vaccine of any one of paragraphs 1-48 further comprising an adjuvant.
50. The vaccine of paragraph 49, wherein the adjuvant is a flagellin protein or peptide.
51. The vaccine of paragraph 50, wherein the flagellin protein or peptide comprises an amino acid sequence identified by any one of SEQ ID NO: 301-303.
52. The vaccine of any one of paragraphs 1-51, wherein the open reading frame is codon-optimized.
53. The vaccine of any one of paragraphs 1-52, wherein the vaccine is multivalent.
54. The vaccine of any one of paragraphs 1-53 formulated in an effective amount to produce an antigen-specific immune response.
55. A method of inducing an immune response in a subject, the method comprising administering to the subject the vaccine of any one of paragraphs 1-54 in an amount effective to produce an antigen-specific immune response in the subject.
56. The method of paragraph 55, wherein the antigen specific immune response comprises a T cell response or a B cell response.
57. The method of paragraph 55 or 56, wherein the subject is administered a single dose of the vaccine.
58. The method of paragraph 55 or 56 wherein the subject is administered a booster dose of the vaccine.
59. The method of any one of paragraphs 55-58, wherein the vaccine is administered to the subject by intradermal injection or intramuscular injection.
60. The method of any one of paragraphs 55-59, wherein an anti-antigenic polypeptide antibody titer produced in the subject is increased by at least 1 log relative to a control.
61. The method of any one of paragraphs 55-60, wherein an anti-antigenic polypeptide antibody titer produced in the subject is increased by 1-3 log relative to a control.
62 The method of any one of paragraphs 55-61, wherein the anti-antigenic polypeptide antibody titer produced in the subject is increased at least 2 times relative to a control.
63. The method of any one of paragraphs 55-62, wherein the anti-antigenic polypeptide antibody titer produced in the subject is increased 2-10 times relative to a control.
64. The method of any one of paragraphs 60-63, wherein the control is an anti-antigenic polypeptide antibody titer produced in a subject who has not been administered a vaccine against the virus.
65. The method of any one of paragraphs 60-63, wherein the control is an anti-antigenic polypeptide antibody titer produced in a subject who has been administered a live attenuated vaccine or an inactivated vaccine against the virus.
66. The method of any one of paragraphs 60-63, wherein the control is an anti-antigenic polypeptide antibody titer produced in a subject who has been administered a recombinant protein vaccine or purified protein vaccine against the virus.
67. The method of any one of paragraphs 60-63, wherein the control is an anti-antigenic polypeptide antibody titer produced in a subject who has been administered a VLP vaccine against the virus.
68. The method of any one of paragraphs 55-67, wherein the effective amount is a dose equivalent to an at least 2-fold reduction in the standard of care dose of a recombinant protein vaccine or a purified protein vaccine against the virus, and wherein an anti-antigenic polypeptide antibody titer produced in the subject is equivalent to an anti-antigenic polypeptide antibody titer produced in a control subject administered the standard of care dose of a recombinant protein vaccine or a purified protein vaccine against the virus, respectively.
69. The method of any one of paragraphs 55-67, wherein the effective amount is a dose equivalent to an at least 2-fold reduction in the standard of care dose of a live attenuated vaccine or an inactivated vaccine against the virus, and wherein an anti-antigenic polypeptide antibody titer produced in the subject is equivalent to an anti-antigenic polypeptide antibody titer produced in a control subject administered the standard of care dose of a live attenuated vaccine or an inactivated vaccine against the virus, respectively.
70. The method of any one of paragraphs 55-67, wherein the effective amount is a dose equivalent to an at least 2-fold reduction in the standard of care dose of a VLP vaccine against the virus, and wherein an anti-antigenic polypeptide antibody titer produced in the subject is equivalent to an anti-antigenic polypeptide antibody titer produced in a control subject administered the standard of care dose of a VLP vaccine against the virus.
71. The method of any one of paragraphs 55-70, wherein the effective amount is a total dose of 50 µg-1000 µg.
72. The method of paragraph 55-71, wherein the effective amount is a dose of 25 µg, 100 µg, 400 µg, or 500 µg administered to the subject a total of two times.
73. The method of any one of paragraphs 55-72, wherein the efficacy of the vaccine against the virus is greater than 65%.
74. The method of any one of paragraphs 55-73, wherein the efficacy of the vaccine against the virus is greater than 80%.
75. The method of any one of paragraphs 55-74, wherein the vaccine immunizes the subject against the virus for up to 2 years.
76. The method of any one of paragraphs 55-74, wherein the vaccine immunizes the subject against the virus for more than 2 years.
77. The method of any one of paragraphs 55-76, wherein the subject has an age of about 12 to about 50 years old.

78. The method of any one of paragraphs 55-77, wherein the subject has been exposed to the virus, wherein the subject is infected with the virus, or wherein the subject is at risk of infection by the virus.

79. The method of any one of paragraphs 55-78, wherein the subject is immunocompromised.

80. The vaccine of any one of paragraphs 1-54 for use in a method of inducing an antigen specific immune response in a subject, the method comprising administering to the subject the vaccine in an amount effective to produce an antigen specific immune response in the subject.

81. Use of the vaccine of any one of paragraphs 1-54 in the manufacture of a medicament for use in a method of inducing an antigen specific immune response in a subject, the method comprising administering to the subject the vaccine in an amount effective to produce an antigen specific immune response in the subject.

82. An engineered nucleic acid encoding at least one RNA polynucleotide of a vaccine of any one of paragraphs 1-54.

83. A tropical disease vaccine, comprising:
at least one messenger ribonucleic acid (mRNA) polynucleotide having a 5' terminal cap, an open reading frame encoding at least one tropical disease antigenic polypeptide, and a 3' polyA tail.

84. The vaccine of paragraph 1, wherein the at least one mRNA polynucleotide is encoded by a sequence identified by any one of SEQ ID NO: 1-28.

85. The vaccine of paragraph 1, wherein the at least one mRNA polynucleotide comprises a sequence identified by any one of SEQ ID NO: 431-461.

86. The vaccine of paragraph 1, wherein the at least one antigenic polypeptide comprises a sequence identified by any one of SEQ ID NO: 31-61.

87. The vaccine of paragraph 1, wherein the at least one mRNA polynucleotide is encoded by a sequence identified by any one of SEQ ID NO: 62-64.

88. The vaccine of paragraph 1, wherein the at least one mRNA polynucleotide comprises a sequence identified by any one of SEQ ID NO: 317-319.

89. The vaccine of paragraph 1, wherein the at least one antigenic polypeptide comprises a sequence identified by any one of SEQ ID NO: 65-72.

90. The vaccine of paragraph 1, wherein the at least one mRNA polynucleotide is encoded by a sequence identified by any one of SEQ ID NO: 184-294.

91. The vaccine of paragraph 1, wherein the at least one mRNA polynucleotide comprises a sequence identified by any one of SEQ ID NO: 320-430.

92. The vaccine of paragraph 1, wherein the at least one antigenic polypeptide comprises a sequence identified by any one of SEQ ID NO: 73-183.

93. The vaccine of any one of paragraphs 83-92, wherein the 5' terminal cap is or comprises 7mG(5')ppp(5')NlmpNp.

94. The vaccine of any one of paragraphs 83-93, wherein 10 of the uracil in the open reading frame is modified to include N1-methyl pseudouridine at the 5-position of the uracil.

95. The vaccine of any one of paragraphs 83-94, wherein the vaccine is formulated in a lipid nanoparticle comprising: DLin-MC3-DMA; cholesterol; 1,2-Distearoyl-sn-glycero-3-phosphocholine (DSPC); and polyethylene glycol (PEG) 2000-DMG.

96. The vaccine of paragraph 95, wherein the lipid nanoparticle further comprises trisodium citrate buffer, sucrose and water.

97. A sexually transmitted disease (STD) vaccine, comprising:
at least one messenger ribonucleic acid (mRNA) polynucleotide having a 5' terminal cap 7mG(5')ppp(5')NlmpNp, a sequence identified by SEQ ID NO; 431-461 and a 3' polyA tail, wherein the uracil nucleotides of the sequence identified by SEQ ID NO: 431-461 are modified to include N1-methyl pseudouridine at the 5-position of the uracil nucleotide.

98. A sexually transmitted disease (STD) vaccine, comprising:
at least one messenger ribonucleic acid (mRNA) polynucleotide having a 5' terminal cap 7mG(5')ppp(5')NlmpNp, a sequence identified by SEQ ID NO: 317-319 and a 3' polyA tail, wherein the uracil nucleotides of the sequence identified by SEQ ID NO: 317-319 are modified to include N1-methyl pseudouridine at the 5-position of the uracil nucleotide.

99. A sexually transmitted disease (STD) vaccine, comprising:
at least one messenger ribonucleic acid (mRNA) polynucleotide having a 5' terminal cap 7mG(5')ppp(5')NlmpNp, a sequence identified by SEQ ID NO: 320-430 and a 3' polyA tail, wherein the uracil nucleotides of the sequence identified by SEQ ID NO: 320-430 are modified to include N1-methyl pseudouridine at the 5-position of the uracil nucleotide, 100. The vaccine of paragraph X formulated in a lipid nanoparticle comprising DLin-MC3-DMA, cholesterol, 1,2-Distearoyl-sn-glycero-3-phosphocholine (DSPC), and polyethylene glycol (PEG)2000-DMG.

This disclosure is not limited in its application to the details of construction and the arrangement of components set forth in the following description or illustrated in the drawings. The disclosure is capable of other embodiments and of being practiced or of being carried out in various ways. Also, the phraseology and terminology used herein is for the purpose of description and should not be regarded as limiting. The use of "including," "comprising," or "having," "containing," "involving," and variations thereof herein, is meant to encompass the items listed thereafter and equivalents thereof as well as additional items.

EXAMPLES

Example 1: Manufacture of Polynucleotides

According to the present disclosure, the manufacture of polynucleotides and/or parts or regions thereof may be accomplished utilizing the methods taught in International Publication WO2014/152027, entitled "Manufacturing Methods for Production of RNA Transcripts," the contents of which is incorporated herein by reference in its entirety.

Purification methods may include those taught in International Publication WO20141152030 and International Publication WO2014/152031, each of which is incorporated herein by reference in its entirety.

Detection and characterization methods of the polynucleotides may be performed as taught in International Publication WO2014/144039, which is incorporated herein by reference in its entirety.

Characterization of the polynucleotides of the disclosure may be accomplished using polynucleotide mapping, reverse transcriptase sequencing, charge distribution analysis, detection of RNA impurities, or any combination of two or more of the foregoing.

"Characterizing" comprises determining the RNA transcript sequence, determining the purity of the RNA transcript, or determining the charge heterogeneity of the RNA transcript, for example. Such methods are taught in, for example, International Publication WO2014/144711 and International Publication WO2014/144767, the content of each of which is incorporated herein by reference in its entirety.

Example 2: Chimeric Polynucleotide Synthesis

According to the present disclosure, two regions or parts of a chimeric polynucleotide may be joined or ligated using triphosphate chemistry. A first region or part of 100 nucleotides or less is chemically synthesized with a 5' monophosphate and terminal 3'desOH or blocked OH, for example. If the region is longer than 80 nucleotides, it may be synthesized as two strands for ligation.

If the first region or part is synthesized as a non-positionally modified region or part using in vitro transcription (IVT), conversion the 5'monophosphate with subsequent capping of the 3' terminus may follow.

Monophosphate protecting groups may be selected from any of those known in the art.

The second region or part of the chimeric polynucleotide may be synthesized using either chemical synthesis or IVT methods. IVT methods may include an RNA polymerase that can utilize a primer with a modified cap. Alternatively, a cap of up to 130 nucleotides may be chemically synthesized and coupled to the IVT region or part.

For ligation methods, ligation with DNA T4 ligase, followed by treatment with DNase should readily avoid concatenation.

The entire chimeric polynucleotide need not be manufactured with a phosphate-sugar backbone. If one of the regions or parts encodes a polypeptide, then such region or part may comprise a phosphate-sugar backbone.

Ligation is then performed using any known click chemistry, orthoclick chemistry, solulink, or other bioconjugate chemistries known to those in the art.

Synthetic Route

The chimeric polynucleotide may be made using a series of starting segments. Such segments include:

(a) a capped and protected 5' segment comprising a normal 3'OH (SEG. 1)

(b) a 5' triphosphate segment, which may include the coding region of a polypeptide and a normal 3'OH (SEG. 2)

(c) a 5' monophosphate segment for the 3' end of the chimeric polynucleotide (e.g., the tail) comprising cordycepin or no 3'OH (SEG. 3)

After synthesis (chemical or IVT), segment 3 (SEG. 3) may be treated with cordycepin and then with pyrophosphatase to create the 5' monophosphate.

Segment 2 (SEG. 2) may then be ligated to SEG. 3 using RNA ligase. The ligated polynucleotide is then purified and treated with pyrophosphatase to cleave the diphosphate. The treated SEG.2-SEG. 3 construct may then be purified and SEG. 1 is ligated to the 5' terminus. A further purification step of the chimeric polynucleotide may be performed.

Where the chimeric polynucleotide encodes a polypeptide, the ligated or joined segments may be represented as: 5'UTR (SEG. 1), open reading frame or ORF (SEG. 2) and 3'UTR+PolyA (SEG. 3).

The yields of each step may be as much as 90-95%.

Example 3: PCR for cDNA Production

PCR procedures for the preparation of cDNA may be performed using 2×KAPA HIFI™ HotStart ReadyMix by Kapa Biosystems (Woburn, Mass.). This system includes 2×KAPA ReadyMix 12.5 μl; Forward Primer (10 μM) 0.75 μl; Reverse Primer (10 μM) 0.75 μl; Template cDNA 100 ng; and dH$_2$O diluted to 25.0 μl. The reaction conditions may be at 95° C., for 5 min. The reaction may be performed for 25 cycles of 98 OC for 20 sec, then 58 OC for 15 sec, then 72° C. for 45 sec, then 72° C. for 5 min, then 4° C. to termination.

The reaction may be cleaned up using Invitrogen's PURELINK™ PCR Micro Kit (Carlsbad, Calif.) per manufacturer's instructions (up to 5 μg). Larger reactions may require a cleanup using a product with a larger capacity. Following the cleanup, the cDNA may be quantified using the NANODROP™ and analyzed by agarose gel electrophoresis to confirm that the cDNA is the expected size. The cDNA may then be submitted for sequencing analysis before proceeding to the in vitro transcription reaction.

Example 4: In Vitro Transcription (IVT)

The in vitro transcription reaction generates RNA polynucleotides. Such polynucleotides may comprise a region or part of the polynucleotides of the disclosure, including chemically modified RNA (e.g., mRNA) polynucleotides. The chemically modified RNA polynucleotides can be uniformly modified polynucleotides. The in vitro transcription reaction utilizes a custom mix of nucleotide triphosphates (NTPs). The NTPs may comprise chemically modified NTPs, or a mix of natural and chemically modified NTPs, or natural NTPs.

A typical in vitro transcription reaction includes the following:

| | | |
|---|---|---|
| 1) | Template cDNA | 1.0 μg |
| 2) | 10x transcription buffer (400 mM Tris-HCl pH 8.0, 190 mM MgCl$_2$, 50 mM DTT, 10 mM Spermidine) | 2.0 μl |
| 3) | Custom NTPs (25 mM each) | 0.2 μl |
| 4) | RNase Inhibitor | 20 U |
| 5) | T7 RNA polymerase | 3000 U |
| 6) | dH$_2$O | up to 20.0 μl and |
| 7) | Incubation at 37° C. for 3 hr-5 hrs. | |

The crude IVT mix may be stored at 4° C. overnight for cleanup the next day. 1 U of RNase-free DNase may then be used to digest the original template. After 15 minutes of incubation at 37° C., the mRNA may be purified using Ambion's MEGACLEAR™ Kit (Austin, Tex.) following the manufacturer's instructions. This kit can purify up to 500 μg of RNA. Following the cleanup, the RNA polynucleotide may be quantified using the NanoDrop and analyzed by agarose gel electrophoresis to confirm the RNA polynucleotide is the proper size and that no degradation of the RNA has occurred.

Example 5: Enzymatic Capping

Capping of a RNA polynucleotide is performed as follows where the mixture includes: IVT RNA 60 μg-180 μg and dH$_2$O up to 72 μl. The mixture is incubated at 65° C. for 5 minutes to denature RNA, and then is transferred immediately to ice.

The protocol then involves the mixing of 10× Capping Buffer (0.5 M Tris-HCl (pH 8.0), 60 mM KCl, 12.5 mM MgCl$_2$) (10.0 μl); 20 mM GTP (5.0 μl); 20 mM S-Adenosyl Methionine (2.5 μl); RNase Inhibitor (100 U); 2'-O-Methyltransferase (400U); Vaccinia capping enzyme (Guanylyl transferase) (40 U); dH$_2$O (Up to 28 µl); and incubation at 37° C. for 30 minutes for 60 µg RNA or up to 2 hours for 180 µg of RNA.

The RNA polynucleotide may then be purified using Ambion's MEGACLEAR™ Kit (Austin, Tex.) following the manufacturer's instructions. Following the cleanup, the RNA may be quantified using the NANODROP™ (ThermoFisher, Waltham, Mass.) and analyzed by agarose gel electrophoresis to confirm the RNA polynucleotide is the proper size and that no degradation of the RNA has occurred. The RNA polynucleotide product may also be sequenced by running a reverse-transcription-PCR to generate the cDNA for sequencing.

Example 6: PolyA Tailing Reaction

Without a poly-T in the cDNA, a poly-A tailing reaction must be performed before cleaning the final product. This is done by mixing capped IVT RNA (100 µl); RNase Inhibitor (20 U); 10× Tailing Buffer (0.5 M Tris-HCl (pH 8.0), 2.5 M NaCl, 100 mM MgCl$_2$) (12.0 µl); 20 mM ATP (6.0 µl); Poly-A Polymerase (20 U); dH$_2$O up to 123.5 µl and incubation at 37° C., for 30 min. If the poly-A tail is already in the transcript, then the tailing reaction may be skipped and proceed directly to cleanup with Ambion's MEGA-CLEAR™ kit (Austin, Tex.) (up to 500 µg). Poly-A Polymerase may be a recombinant enzyme expressed in yeast.

It should be understood that the processivity or integrity of the polyA tailing reaction may not always result in an exact size polyA tail. Hence, polyA tails of approximately between 40-200 nucleotides. e.g., about 40, 50, 60, 70, 80, 90, 91, 92, 93, 94, 95, 96, 97, 98, 99, 100, 101, 102, 103, 104, 105, 106, 107, 108, 109, 110, 150-165, 155, 156, 157, 158, 159, 160, 161, 162, 163, 164 or 165 are within the scope of the present disclosure.

Example 7: Natural 5' Caps and 5' Cap Analogues

5'-capping of polynucleotides may be completed concomitantly during the in vitro-transcription reaction using the following chemical RNA cap analogs to generate the 5'-guanosine cap structure according to manufacturer protocols: 3'-O-Me-m7G(5')ppp(5') G [the ARCA cap]; G(5')ppp(5')A; G(5')ppp(5')G; m7G(5')ppp(5')A; m7G(5')ppp(5')G (New England BioLabs, Ipswich, Mass.). 5'-capping of modified RNA may be completed post-transcriptionally using a Vaccinia Virus Capping Enzyme to generate the "Cap 0" structure: m7G(5')ppp(5')G (New England BioLabs, Ipswich, Mass.). Cap 1 structure may be generated using both Vaccinia Virus Capping Enzyme and a 2'-O methyl-transferase to generate: m7G(5')ppp(5')G-2'-O-methyl. Cap 2 structure may be generated from the Cap 1 structure followed by the 2'-O-methylation of the 5'-antepenultimate nucleotide using a 2'-O methyl-transferase. Cap 3 structure may be generated from the Cap 2 structure followed by the 2'-O-methylation of the 5'-preantepenultimate nucleotide using a 2'-O methyl-transferase. Enzymes are preferably derived from a recombinant source.

When transfected into mammalian cells, the modified mRNAs have a stability of between 12-18 hours or more than 18 hours, e.g., 24, 36, 48, 60, 72 or greater than 72 hours.

Example 8: Capping Assays

Protein Expression Assay

Polynucleotides (e.g., mRNA) encoding a polypeptide, containing any of the caps taught herein, can be transfected into cells at equal concentrations. The amount of protein secreted into the culture medium can be assayed by ELISA at 6, 12, 24 and/or 36 hours post-transfection. Synthetic polynucleotides that secrete higher levels of protein into the medium correspond to a synthetic polynucleotide with a higher translationally-competent cap structure.

Purity Analysis Synthesis

RNA (e.g., mRNA) polynucleotides encoding a polypeptide, containing any of the caps taught herein can be compared for purity using denaturing Agarose-Urea gel electrophoresis or HPLC analysis. RNA polynucleotides with a single, consolidated band by electrophoresis correspond to the higher purity product compared to polynucleotides with multiple bands or streaking bands. Chemically modified RNA polynucleotides with a single HPLC peak also correspond to a higher purity product. The capping reaction with a higher efficiency provides a more pure polynucleotide population.

Cytokine Analysis

RNA (e.g., mRNA) polynucleotides encoding a polypeptide, containing any of the caps taught herein can be transfected into cells at multiple concentrations. The amount of pro-inflammatory cytokines, such as TNF-alpha and IFN-beta, secreted into the culture medium can be assayed by ELISA at 6, 12, 24 and/or 36 hours post-transfection. RNA polynucleotides resulting in the secretion of higher levels of pro-inflammatory cytokines into the medium correspond to a polynucleotides containing an immune-activating cap structure.

Capping Reaction Efficiency

RNA (e.g., mRNA) polynucleotides encoding a polypeptide, containing any of the caps taught herein can be analyzed for capping reaction efficiency by LC-MS after nuclease treatment. Nuclease treatment of capped polynucleotides yield a mixture of free nucleotides and the capped 5'-5-triphosphate cap structure detectable by LC-MS. The amount of capped product on the LC-MS spectra can be expressed as a percent of total polynucleotide from the reaction and correspond to capping reaction efficiency. The cap structure with a higher capping reaction efficiency has a higher amount of capped product by LC-MS.

Example 9: Agarose Gel Electrophoresis of Modified RNA or RT PCR Products

Individual RNA polynucleotides (200-400 ng in a 20 µl volume) or reverse transcribed PCR products (200-400 ng) may be loaded into a well on a non-denaturing 1.2% Agarose E-Gel (Invitrogen, Carlsbad, Calif.) and run for 12-15 minutes, according to the manufacturer protocol.

Example 10: Nanodrop Modified RNA Quantification and UV Spectral Data

Chemically modified RNA polynucleotides in TE buffer (1 µl) are used for Nanodrop UV absorbance readings to quantitate the yield of each polynucleotide from an chemical synthesis or in vitro transcription reaction.

Example 11: Formulation of Modified mRNA Using Lipidoids

RNA (e.g., mRNA) polynucleotides may be formulated for in vitro experiments by mixing the polynucleotides with the lipidoid at a set ratio prior to addition to cells. In vive formulation may require the addition of extra ingredients to facilitate circulation throughout the body. To test the ability of these lipidoids to form particles suitable for in vivo work, a standard formulation process used for siRNA-lipidoid formulations may be used as a starting point. After formation of the particle, polynucleotide is added and allowed to integrate with the complex. The encapsulation efficiency is determined using a standard dye exclusion assays.

Example 12: HPV Immunogenicity Study

The instant study is designed to test the immunogenicity in mice of candidate HPV vaccines comprising a chemically modified or unmodified mRNA polynucleotide encoding HPV L1 protein obtained from HPV serotypes 6, 11, 16, 18, 31, 33, 35, 39, 45, 51, 52, 56, 58, 59, 68, 73 or 82.

Mice are immunized intravenously (IV), intramuscularly (IM), or intradermally (ID) with candidate vaccines. Up to three immunizations are given at 3-week intervals (i.e., at weeks 0, 3, 6, and 9), and sera are collected after each immunization until weeks 33-51. Serum antibody titers against HPV L1 protein are determined by ELISA.

Example 13: HPV Challenge

The instant study is designed to test the efficacy in guinea pig of candidate HPV vaccines against a lethal challenge using a HPV vaccine comprising a chemically modified or unmodified mRNA encoding HPV L1 protein obtained from HPV serotypes 6, 11, 16, 18, 31, 33, 35, 39, 45, 51, 52, 56, 58, 59, 68, 73 or 82. Animals are challenged with a lethal dose of the HPV.

Animals are immunized intravenously (IV), intramuscularly (IM), or intradermally (ID) at week 0 and week 3 with candidate HPV vaccines with and without adjuvant. The animals are then challenged with a lethal dose of HPV on week 7 via IV, IM or ID. Endpoint is day 13 post infection, death or euthanasia. Animals displaying severe illness as determined by >30% weight loss, extreme lethargy or paralysis are euthanized. Body temperature and weight are assessed and recorded daily.

In experiments where a lipid nanoparticle (LNP) formulation is used, the formulation may include a cationic lipid, non-cationic lipid, PEG lipid and structural lipid in the ratios 50:10:1.5:38.5. The cationic lipid is DLin-KC2-DMA (50 mol %) or DLin-MC3-DMA (50 mol %), the non-cationic lipid is DSPC (10 mol %), the PEG lipid is PEG-DOMG (1.5 mol %) and the structural lipid is cholesterol (38.5 mol %), for example.

Efficacy of HPV vaccine candidates against HPV challenge are compared to efficacy of vaccination of animals with Gardasil® (Human Papillomavirus Quadrivalent (Types 6, 11, 16, and 18) Vaccine, Recombinant, Merck).

Example 14: *Chlamydia* Immunogenicity Study

Figure 4:
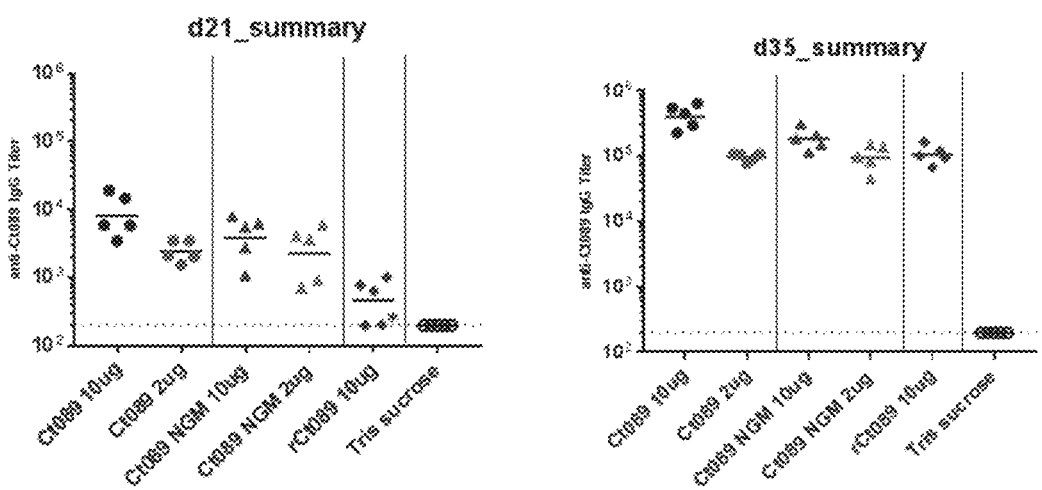
FIG. 4 shows data from an ELISA of sera collected from mice bled on day 21 (post prime; left graph) and on day 35 (post-boost, right graph), analyzed for IgG antibody titers against Ct089 using rCt089 produced in *E. coli* as the antigen, following administration of Ct089mRNA, Ct089NGM mRNA or rCt089.

The instant study was designed to test the immunogenicity in C57BL/6 mice with different *Chlamydia* Ct089mRNA vaccines. Mice (n=10) were immunized intramuscularly (IM) with candidate vaccines designated Ct089mRNA, Ct089NGM mRNA (N-glycosylated) or rCt089 protein (in Addvax). 2 µg or 10 µg doses in a 50 µl volume were administered to mice on day 0 and on day 21 (boost). The MC3/mRNA concentration used was 0.2 mg/ml for 10 µg dose, or 0.04 mg/ml for 2 µg dose. Mice were bled for serum preparation on day −3, 21 and 35. Anti-Ct089 antibody titers in serum were measured using rCt089 produced in *E. coli* as the antigen. FIG. 4 shows antibody titers measured on day 21 and on day 35.

Excellent IgG titers were detected with native Ct089mRNA (present after single dose and boosted after second dose). Dose titration was observed with lower dose immunization, but positive titers were observed with both 2 µg and 10 µg doses. 10 µg Ct089mRNA responses surpass the 10 µg rCt089 protein control.

N-glycosylation mutant Ct089 (Ct089NGM) mRNA was also immunogenic but to a slightly weaker extent.

Ct089 is a promising Ct vaccine antigen candidate. Ct089 displayed both N- and O-glycosylation when expressed in mammalian cells. Given the extensive glycosylation observed with Ct089, mammalian glycosylation of mRNA encoded bacterial proteins in mammalian cells does not appear to mask immune epitopes or impede immunogenicity.

Example 15: *Chlamydia trachomatis* Rodent Challenge

The instant study is designed to test the efficacy in Guinea pigs of candidate *Chlamydia* vaccines against a lethal challenge using a *Chlamydia* vaccine comprising chemically modified or unmodified mRNA encoding MOMP obtained from *Chlamydia trachomatis* serovar H, F, E, D, I, G, J or K. Mice are challenged with a lethal dose of the *Chlamydia trachomatis*.

Animals are immunized intravaginally (IG), intramuscularly (IM), or intradermally (ID) at week 0 and week 3 with candidate *Chlamydia* vaccines with and without adjuvant. The animals are then challenged with a lethal dose of *Chlamydia trachomatis* on week 7 via an IG, IM or ID route. Endpoint is day 13 post infection, death or euthanasia. Animals displaying severe illness as determined by >30% weight loss, extreme lethargy or paralysis are euthanized. Body temperature and weight are assessed and recorded daily.

In experiments where a lipid nanoparticle (LNP) formulation is used, the formulation may include a cationic lipid, non-cationic lipid. PEG lipid and structural lipid in the ratios 50:10:1.5:38.5. The cationic lipid is DLin-KC2-DMA (50 mol %), the non-cationic lipid is DSPC (10 mol %), the PEG lipid is PEG-DOMG (1.5 mol %) and the structural lipid is cholesterol (38.5 mol %), for example.

Example 16: In Vitro Expression of *Chlamydia trachomatis* Antigens from Candidate mRNA Vaccines This study was designed to test the in vitro expression of *Chlamydia trachomatis* antigens from candidate mRNA vaccines. Candidate mRNA vaccines encoding MOMP, Ct875, Ct858, Ct089, PmPG_pd, Ct460, Ct622, Cta1, Ct443, or Ct812pd_D were tested. The candidate mRNA vaccines encoding MOMP were transfected into Hela cells. The expression of MOMP in Hela cells was visualized by immunofluorescence by staining the transfected Hela cells using mouse anti-MOMP antibodies. Fluorescent microscopy images showed co-localization of the anti-MOMP antibodies and Hela cells (data not shown). The mRNA vaccine constructs encoding Ct875, Ct858, Ct089, PmPG_pd. Ct460, Ct622, Cta1, Ct443, or Ct812pd_D were transfected into HEK293F cells. Twenty hours post transfection, the cell culture supernatant (concentrated or dilute) or HEK293F cell lysates were collected and the expression of the antigens were analyzed by Western blot. The *Chlamydia trachomatis* antigens were tagged with a His×6 tag. Mouse anti-6×His antibodies were used as the primary antibody, and anti-mouse A1647 antibodies were used as the secondary antibody. The cellular GAPDH was also detected as control. Rabbit anti-GAPDH antibodies were used as the primary antibody, and anti-rabbit C3 antibodies were used as the secondary antibody. The results of the Western blot are shown in FIGS. 1A-1B, FIGS. 2A-2B, FIG. 3 and Table 14.

Each of the sequences described herein encompasses a chemically modified sequence or an unmodified sequence which includes no modifications.

Lengthy table referenced here

US10493143-20191203-T00001

Please refer to the end of the specification for access instructions.

Lengthy table referenced here

US10493143-20191203-T00002

Please refer to the end of the specification for access instructions.

Lengthy table referenced here

US10493143-20191203-T00003

Please refer to the end of the specification for access instructions.

Lengthy table referenced here

US10493143-20191203-T00004

Please refer to the end of the specification for access instructions.

Lengthy table referenced here

US10493143-20191203-T00005

Please refer to the end of the specification for access instructions.

Lengthy table referenced here

US10493143-20191203-T00006

Please refer to the end of the specification for access instructions.

Lengthy table referenced here

US10493143-20191203-T00007

Please refer to the end of the specification for access instructions.

Lengthy table referenced here

US10493143-20191203-T00008

Please refer to the end of the specification for access instructions.

Lengthy table referenced here

US10493143-20191203-T00009

Please refer to the end of the specification for access instructions.

Lengthy table referenced here

US10493143-20191203-T00010

Please refer to the end of the specification for access instructions.

Lengthy table referenced here

US10493143-20191203-T00011

Please refer to the end of the specification for access instructions.

Lengthy table referenced here

US10493143-20191203-T00012

Please refer to the end of the specification for access instructions.

Lengthy table referenced here

US10493143-20191203-T00013

Please refer to the end of the specification for access instructions.

Lengthy table referenced here

US10493143-20191203-T00014

Please refer to the end of the specification for access instructions.

EQUIVALENTS

Those skilled in the art will recognize, or be able to ascertain using no more than routine experimentation, many equivalents to the specific embodiments of the disclosure described herein. Such equivalents are intended to be encompassed by the following claims.

All references, including patent documents, disclosed herein are incorporated by reference in their entirety.

LENGTHY TABLES

The patent contains a lengthy table section. A copy of the table is available in electronic form from the USPTO web site (http://seqdata.uspto.gov/?pageRequest=docDetail&DocID=US10493143B2). An electronic copy of the table will also be available from the USPTO upon request and payment of the fee set forth in 37 CFR 1.19(b)(3).

SEQUENCE LISTING (463 sequences)

SEQ ID NO: 1 - DNA, 1500 bp, Human papillomavirus
atgtggcggcctagcgacagcacagtatatgtgcctcctcctaaccctgtatccaaagttgttgccacggatgcttatgttactcgcaccaacatattttatcatgccagcagttccagacttcttgcagtgggacatccttatttttccataaaacgggctaacaaaactgttgtgccaaaggtgtcaggatatcaatacagggtatttaaggtggtgttaccagatcctaacaaatttgcattgcctgactcgtctcttttcgatcccacaacacaacgtttagtatgggcatgcacaggcctagaggtgggcaggggacagccattaggtgtgggtgtaagtggacatcctttcctaaataaatatgatgatgttgaaaattcagggagtggtggtaaccctggacaggataacagggttaatgtaggtatggattataaacaaacacaattatgcatggttggatgtgccccccctttgggcgagcattggggtaaaggtaaacagtgtactaatacacctgtacaggctggtgactgcccgcccttagaacttattaccagtgttatacaggatggcgatatggttgacacaggctttggtgctatgaattttgctgatttgcagaccaataaatcagatgttcctattgacatatgtggcactacatgtaaatatccagattatttacaaatggctgcagacccatatggtgatagattatttttttttctacggaaggaacaaatgtttgccagacatttttttaacagggctggcgaggtgggggaacctgtgcctgatacacttataattaagggtagtggaaatcgcacgtctgtagggagtagtatatatgttaacaccccgagcggctctttggtgtcctctgaggcacaattgtttaataagccatattggctacaaaaagcccagggacataacaatggtatttgttggggtaatcaactgtttgttactgtggtagataccacacgcagtaccaacatgacattatgtgcatccgtaactacatcttccacatacaccaattctgattataaagagtacatgcgtcatgtggaagagtatgatttacaatttatttttcaattatgtagcattacattgtctgctgaagtaatggcctatattcacacaatgaatccctctgttttggaagactggaactttgggttatcgcctcccccaaatggtacattagaagatacctataggtatgtgcagtcacaggccattacctgtcaaaagcccactcctgaaaaggaaaagccagatccctataagaaccttagtttttgggaggttaatttaaaagaaaagttttctagtgaattggatcagtatcctttgggacgcaagtttttgttacaaagtggatataggggacggtcctctattcgtacaggtgttaagcgccctgctgtttccaaagcctctgctgcccctaaacgtaagcgcgccaaaactaaaagg

SEQ ID NO: 2 - DNA, 1503 bp, Human papillomavirus
atgtggcggcctagcgacagcacagtatatgtgcctcctcccaaccctgtatccaaggttgttgccacggatgcgtatgttaaacgcaccaacatattttatcatgccagcagttccagactccttgctgtgggacatccatattactctatcaaaaaagttaacaaaacagttgtaccaaaggtgtctggatatcaatatagagtgtttaaggtagtgttgccagatcctaacaagtttgcattacctgattcatccctgtttgaccccactacacagcgtttagtatgggcgtgcacagggttggaggtaggcaggggtcaacctttaggcgttggtgttagtgggcatccattgctaaacaaatatgatgatgtagaaaatagtggtgggtatggtggtaatcctggtcaggataatagggttaatgtaggtatggattataaacaaacccagctatgtatggtgggctgtgctccaccgttaggtgaacattggggtaagggtacacaatgttcaaatacctctgtacaaaatggtgactgccccccgttggaacttattaccagtgttatacaggatggggacatggttgatacaggctttggtgctatgaattttgcagacttacaaaccaataaatcggatgttccccttgatatttgtggaactgtctgcaaatatcctgattatttgcaaatggctgcagacccttatggtgataggttgtttttttatttgcgaaaggaacaaatgtttgctagacacttttttaatagggccggtactgtgggggaacctgtgcctgatgacctgttggtaaaagggggtaataacagatcatctgtagctagtagtatttatgtacatacacctagtggctcattggtgtcttcagaggctcaattatttaataaaccatattggcttcaaaaggctcagggacataacaatggtatttgctggggaaaccacttgtttgttactgtggtagataccacacgcagtacaaatatgacactatgtgcatctgtgtctaaatctgctacatacactaattcagattataaggaatacatgcgccatgtggaggagtttgatttacagtttatttttcaattgtgtagcattacattatctgcagaagtcatggcctatatacacacaatgaatccttctgttttggaggactggaactttggtttatcgcctccaccaaatggtacactggaggatacttatagatatgtacagtcacaggccattacctgtcagaaacccacacctgaaaaagaaaaacaggatccctataaggatatgagtttttgggaggttaacttaaaagaaaagttttcaagtgaattagatcagtttccccttggacgtaagtttttattgcaaagtggatatcgaggacggacgtctgctcgtacaggtataaagcgcccagctgtgtctaagccctctacagcccccaaacgaaaacgtaccaaaaccaaaaag

SEQ ID NO: 3 - DNA, 1515 bp, Human papillomavirus
atgtctctttggctgcctagtgaggccactgtctacttgcctcctgtcccagtatctaaggttgtaagcacggatgaatatgttgcacgcacaaacatatattatcatgcaggaacatccagactacttgcagttggacatccctattttcctattaaaaaacctaacaataacaaaatattagttcctaaagtatcaggattacaatacagggtatttagaatacatttacctgaccccaataagtttggttttcctgacacctcattttataatccagatacacagcggctggtttgggcctgtgtaggtgttgaggtaggtcgtggtcagccattaggtgtgggcattagtggccatcctttattaaataaattggatgacacagaaaatgctagtgcttatgcagcaaatgcaggtgtggataatagagaatgtatatctatggattacaaacaaacacaattgtgtttaattggttgcaaaccacctataggggaacactggggcaaaggatccccatgtaccaatgttgcagtaaatccaggtgattgtccaccattagagttaataaacacagttattcaggatggtgatatggttgatactggctttggtgctatggactttactacattacaggctaacaaaagtgaagttccactggatatttgtacatctatttgcaaatatccagattatattaaaatggtgtcagaaccatatggcgacagcttatttttttatttacgaagggaacaaatgtttgttagacatttatttaatagggctggtactgttggtgaaaatgtaccagacgatttatacattaaaggctctgggtctactgcaaatttagccagttcaaattattttcctacacctagtggttctatggttacctctgatgcccaaatattcaataaaccttattggttacaacgagcacagggccacaataatggcatttgttggggtaaccaactatttgttactgttgttgatactacacgcagtacaaatatgtcattatgtgctgccatatctacttcagaaactacatataaaaatactaactttaaggagtacctacgacatggggaggaatatgatttacagtttatttttcaactgtgcaaaataaccttaactgcagacgttatgacatacatacattctatgaattccactattttggaggactggaattttggtctacaacctcccccaggaggcacactagaagatacttataggtttgtaacatcccaggcaattgcttgtcaaaaacatacacctccagcacctaaagaagatccccttaaaaaatacactttttgggaagtaaatttaaaggaaaagttttctgcagacctagatcagtttcctttaggacgcaaatttttactacaagcaggattgaaggccaaaccaaaatttacattaggaaaacgaaaagctacacccaccacctcatctacctctacaactgctaaacgcaaaaaacgtaagctg

SEQ ID NO: 4 - DNA, 1521 bp, Human papillomavirus
atggctttgtggcggcctagtgacaataccgtatatcttccacctccttctgtggcaagagttgtaaataccgatgattatgtgactcgcacaagcatattttatcatgctggcagctccagattattaactgttggtaatccatattttagggttcctgcaggtggtggcaataagcaggatattcctaaggtttctgcataccaatatagagtatttagggtgcagttacctgacccaaataaatttggtttacctgatactagtatttataatcctgaaacacaacgtttagtgtgggcctgtgctggagtggaaattggccgtggtcagcctttaggtgttggccttagtgggcatccattttataataaattagatgacactgaaagttcccatgccgccacgtctaatgtttctgaggacgttagggacaatgtgtctgtagattataagcagacacagttatgtattttgggctgtgcccctgctattggggaacactgggctaaaggcactgcttgtaaatcgcgtcctttatcacagggcgattgcccccctttagaacttaaaaacacagttttggaagatggtgatatggtagatactggatatggtgccatggactttagtacattgcaagatactaaatgtgaggtaccattggatatttgtcagtctatttgtaaatatcctgattatttacaaatgtctgcagatccttatggggattccatgtttttttgcttacggcgtgagcagctttttgctaggcatttttggaatagagcaggtactatgggtgacactgtgcctcaatccttatatattaaaggcacaggtatgcgtgcttcacctggcagctgtgtgtattctccctctccaagtggctctattgttacctctgactcccagttgtttaataaaccatattggttacataaggcacagggtcataacaatggtgtttgctggcataatcaattatttgttactgtggtagataccactcgcagtaccaatttaacaatatgtgcttctacacagtctcctgtacctgggcaatatgatgctaccaaatttaagcagtatagcagacatgttgaggaatatgatttgcagtttatttttcagttgtgtactattactttaactgcagatgttatgtcctatattcatagtatgaatagcagtattttagaggattggaactttggtgttccccccccgccaactactagtttggtggatacatatcgttttgtacaatctgttgctattacctgtcaaaaggatgctgcaccggctgaaaataaggatccctatgataagttaaagttttggaatgtggatttaaaggaaaagttttctttagacttagatcaatatccccttggacgtaaatttttggttcaggctggattgcgtcgcaagcccaccataggccctcgcaaacgttctgctccatctgccactacgtcttctaaacctgccaagcgtgtgcgtgtacgtgccaggaag

SEQ ID NO: 5 - DNA, 1512 bp, Human papillomavirus
atgtctctgtggcggcctagcgaggctactgtctacttaccacctgtcccagtgtctaaagttgtaagcacggatgaatatgtaacacgaaccaacatatattatcacgcaggcagtgctaggctgcttacagtaggccatccatattattccatacctaaatctgacaatcctaaaaaaatagttgtaccaaaggtgtcaggattacaatatagggtatttagggttcgtttaccagatccaaacaaatttggatttcctgatacatctttttataatcctgaaactcaacgcttagtttgggcctgtgttggtttagaggtaggtcgcgggcagccattaggtgtaggtattagtggtcatccattattaaataaatttgatgacactgaaaactctaatagatatgccggtggtcctggcactgataatagggaatgtatatcaatggattataaacaaacacaactgtgtttacttggttgcaaaccacctattggagagcattggggtaaaggtagtccttgtagtaacaatgctattacccctggtgattgtcctccattagaattaaaaaattcagttatacaagatggggatatggttgatacaggctttggagctatggattttactgctttacaagacactaaaagtaatgttcctttggacatttgtaattctatttgtaaatatccagattatcttaaaatggttgctgagccatatggcgatacattatttttttatttacgtagggaacaaatgtttgtaaggcatttttttaatagatcaggcacggttggtgaatcggtccctactgacttatatattaaaggctccggttcaacagctactttagctaacagtacatactttcctacacctagcggctccatggttacttcagatgcacaaatttttaataaaccatattggatgcaacgtgctcagggacacaataatggtatttgttggggcaatcagttatttgttactgtggtagataccacacgtagtaccaatatgtctgtttgtgctgcaattgcaaacagtgatactacatttaaaagtagtaattttaaagagtatttaagacatggtgaggaatttgatttacaatttatatttcagttatgcaaaataacattatctgcagacataatgacatatattcacagtatgaatcctgctattttggaagattggaattttggattgaccacacctccctcaggttctttggaggatacctataggtttgtcacctcacaggccattacatgtcaaaaaactgccccccaaaagcccaaggaagatccatttaaagattatgtattttgggaggttaatttaaaagaaaagttttctgcagatttagatcagtttccactgggtcgcaaatttttattacaggcaggatatagggcacgtcctaaatttaaagcaggtaaacgtagtgcaccctcagcatctaccactacaccagcaaaacgtaaaaaaactaaaaag

SEQ ID NO: 6 - DNA, 1497 bp, Human papillomavirus
atgtccgtgtggcggcctagtgaggccacagtgtacctgcctcctgtacctgtatctaaagttgtcagcactgatgaatatgtgtctcgcacaagcatttattattatgctggtagttccagacttcttgctgttggccatccatatttttctattaaaaatcctactaacgctaaaaaattattggtacccaaagtatcaggcttgcaatatagggtttttagggtccgtttaccagatcctaataaatttggatttcctgacacctccttttataaccctgatacacaacgattagtatgggcatgtgtaggccttgaaataggtagagggcagccattaggcgttggcataagtggtcatcctttattaaacaaatttgatgacactgaaaccggtaacaagtatcctggacaaccgggtgctgataatagggaatgtttatccatggattataaacaaacacagttatgtttacttggatgtaagcctccaacaggggaacattggggtaaaggtgttgcttgtactaatgcagcacctgccaatgattgtccacctttagaacttataaatactattattgaggatggtgatatggtggacacaggatttggttgcatggattttaaaacattgcaggctaataaaagtgatgttcctattgatatttgtggcagtacatgcaaatatccagattatttaaaaatgactagtgagccttatggtgatagtttatttttctttcttcgacgtgaacaaatgtttgtaagacacttttttaatagggctggtacattaggagaggctgttcccgatgacctgtacattaaaggttcaggaactactgcctctattcaaagcagtgctttttttcccactcctagtggatcaatggttacttccgaatctcagttatttaataagccatattggctacaacgtgcacaaggtcataataatggtatttgttggggcaatcaggtatttgttactgtggtagataccactcgcagtactaatatgactttatgcacacaagtaactagtgacagtacatataaaaatgaaaattttaaagaatatataagacatgttgaagaatatgatctacagtttgtttttcaactatgcaaagttaccttaactgcagaagttatgacatatattcatgctatgaatccagatattttagaagattggcaatttggtttaacacctcctccatctgctagtttacaggatacctataggtttgttacctctcaggctattacgtgtcaaaaaacagtacctccaaaggaaaaggaagaccccttaggtaaatatacattttgggaagtggatttaaaggaaaaattttcagcagatttagatcagtttcctttgggacgcaagtttttattacaggcaggtcttaaagcaaaacctaaacttaaacgtgcagcccccacatccacccgcacatcgtctgcaaaacgcaaaaaggttaaaaaa

SEQ ID NO: 7 - DNA, 1506 bp, Human papillomavirus
atgtctctgtggcggtctaacgaagccactgtctacctgcctccagtgtcagtgtctaaggttgttagcactgatgaatatgtaacacgcacaaacatctactatcatgcaggcagttctaggctattagctgtgggtcacccatactatgctattaaaaaacaagattctaataaaatagcagtacccaaggtatctggtttgcaatacagagtatttagagtaaaattaccagatcctaataagtttggatttccagacacatcattttatgatcctgcctcccagcgtttggtttgggcctgtacaggagttgaagtaggtcgtggtcagccattgggtgtaggtattagtggtcatcctttactcaataaattggatgatactgaaaattctaataaatatgttggtaactctggtacagataacagggaatgcatttctatggattataaacaaacacaattgtgtttaataggttgtaggcctcctataggtgaacattggggaaaaggcacaccttgtaatgctaaccaggtaaaagcaggagaatgtcctcctttggagttactaaacactgtactacaagacggggacatggtagacacaggatttggtgcaatggattttactacattacaagctaataaaagtgatgttcccctagatatatgcagttccatttgcaaatatcctgattatctaaaaatggtttctgagccatatggagatatgttatttttttatctacgtagggagcaaatgtttgtgagacatttatttaatagggctggaactgtaggtgaaacagtacctgcagacctatatattaagggtaccactggcacattgcctagtactagttattttcctactcctagtggctctatggtaacctccgatgcacaaatatttaataaaccatattggttgcaacgtgcacaaggccataataatggtatttgttggagtaaccaattgtttgttactgtagttgatacaacccgtagtacaaatatgtctgtgtgttctgctgtgtcttctagtgacagtacatataaaaacgacaattttaaggaatatttaaggcatggtgaagaatatgacctgcagtttatttttcagttatgtaaaataacactaacagcagatgttatgacatatattcatagtatgaacccgtccattttagaggattggaattttggccttacaccaccgccttctggtaccttagaggacacatatcgctatgtaacatcacaggctgtaacttgtcaaaaacccagtgcaccaaaacctaaagatgatccattaaaaaattatactttttgggaggttgatttaaaggaaaagttttctgcagacttagatcaatttccgttgggccgtaaatttttgttacaagcaggactaaaggccaggcctaattttagattaggcaagcgtgcagctccagcatctacatctaaaaaatcttctactaaacgtagaaaagtaaaaagt

SEQ ID NO: 8 - DNA, 1515 bp, Human papillomavirus
atggctatgtggcggtctagtgacagcatggtgtatttgcctccaccttctgtggcgaaggttgtcaatactgatgattatgttacacgcacaggcatatattattatgctggcagctccagattattaacagtaggacatccatattttaaagtgggtatgaatggtggtcgcaagcaggacattccaaaggtgtctgcatatcaatatagggtatttcgcgtgacattgcccgatcctaataaattcagtattccagatgcatccttatataatccagaaacacaacgtttagtatgggcttgtgtaggggtggaggtgggcaggggccagccattgggtgttggtattagtggacacccattatataatagacaggatgatactgaaaactcaccattttcatcaaccaccaataaggacagtagggataatgtgtctgtggattataaacagacacagttgtgcattataggctgtgttcccgccattggggagcactggggtaagggaaaggcatgcaagcccaataatgtatctacgggggactgtcctcctttggaactagtaaacacccctattgaggatggtgatatgattgatactggctatggagctatggactttggtgcattgcaggaaaccaaaagtgaggtgcctttagatatttgtcaatccatttgtaaatatcctgattatttgcaaatgtctgcagatgtgtatggggacagtatgttcttctgtttacgtagggaacaactgtttgcaagacatttttggaatcgtggtggtatggtgggtgacgccattcctgcccaattgtatattaagggcacagatatacgtgcaaaccccggtagttctgtatactgcccctctcccagcggttccatggtaacctctgattcccagttatttaataagccttattggctacataaggcccagggccacaacaatggtatatgttggcataatcaattatttcttactgttgtggacactacccgtagtaccaactttacattatctacctctatagagtcttccataccttctacatatgatccttctaagtttaaggaatataccaggcacgtggaggagtatgatttacagtttatatttcaactgtgtactgtcacattaacaactgatgttatgtcttatattcacactatgaattcctctatattggacaattggaattttgctgtagctcctccaccatctgccagtttggtagacacttacagatacctacagtctgcagccattacatgtcaaaaggatgctccagcacctgaaaagaaagatccatatgacggtctaaagttttggaatgttgacttaagggaaaagtttagtttggaacttgatcaattccctttgggacgtaaatttttgttgcaggccagggtccgcaggcgccctactataggtccccgaaagcggcctgctgcatccacttcctcgtcctcagctactaaacacaaacgtaaacgtgtgtctaaa

SEQ ID NO: 9 - DNA, 1539 bp, Human papillomavirus
atggctttgtggcggcctagtgacagtacggtatatcttccaccaccttctgtggccagagttgtcagcactgatgattatgtgtctcgcacaagcatattttatcatgcaggcagttcccgattattaactgtaggcaatccatattttagggttgtacctaatggtgcaggtaataaacaggctgttcctaaggtatccgcatatcagtatagggtgtttagagtagctttacccgatcctaataaatttggattacctgattctactatatataatcctgaaacacaacgtttggtttgggcatgtgtaggtatggaaattggtcgtgggcagcctttaggtattggcctaagtggccatccattttataataaattggatgatacagaaagtgctcatgcagctacagctgttattacgcaggatgttagggataatgtgtcagttgattataagcaaacacagctgtgtattttaggttgtgtacctgctattggtgagcactgggccaagggcacactttgtaaacctgcacaattgcaacctggtgactgtcctcctttggaacttaaaaacaccattattgaggatggtgatatggtggatacaggttatggggcaatggattttagtacattgcaggatacaaagtgcgaggttccattagacatttgtcaatccatctgtaaatatccagattatttgcaaatgtctgctgatccctatggggattctatgtttttttgcctacgccgtgaacaactgtttgcaagacatttttggaatagggcaggtgttatgggtgacacagtacctacggacctatatattaaaggcactagcgctaatatgcgtgaaacccctggcagttgtgtgtattccccttctcccagtggctctattattacttctgattctcaattatttaataagccatattggttacataaggcccagggccataacaatggtatttgttggcataatcagttgtttgttactgtagtggacactacccgcagtactaatttaacattatgtgcctctacacaaaatcctgtgccaagtacatatgaccctactaagtttaagcagtatagtagacatgtggaggaatatgatttacagtttatttttcagttgtgcactattactctcactgcagaggttatgtcatatatccatagtatgaatagtagtatattagaaaattggaattttggtgtccctccaccacctactacaagtttggtggatacatatcgttttgtgcaatcagttgctgttacctgtcaaaaggatactacacctccagaaaagcaggatccatatgataaattaaagttttggactgttgacctaaaggaaaaattttcctccgatttggatcaatatccccttggtcgaaagtttttagttcaggctgggttacgtcgtaggcctaccataggacctcgtaagcgtcctgctgcttccacgtctactgcatctactgcatctaggcctgccaaacgtgtacgtatacgtagtaagaaa

SEQ ID NO: 10 - DNA, 1512 bp, Human papillomavirus
atggcattgtggcgcactaatgacagcaaggtgtatttgccacctgcacctgtgtctcgaattgtgaatacagaagaatatatcacacgcaccggcatatattactatgcaggcagttccagactaataacattaggacatccctattttccaatacctaaaacctcaacgcgtgctgctattcctaaagtatctgcatttcaatacagggtatttagggtacagttaccagatcctaacaagtttggactcccggatccaaatttatataatccagacacagataggttggtgtggggttgtgtgggcgttgaggtgggcagaggacagccccttggtgttggccttagtggtcatcccttatttaataaatatgatgacacagaaaattcacgcatagcaaatggcaatgcacaacaagatgttagagataacacatctgttgacaacaaacagactcagttatgtataataggctgtgctccacctattggggaacactggggtattggcactacatgcaaaaacacacctgtacctccaggagactgcccccccctggaacttgtatcctctgtcattcaggatggcgatatgattgatacagggtttggagctatggatttcgctgccctacaggccaccaaatcagacgtccctttggatatttcacagtctgtttgtaaatatcctgattatttaaaaatgtctgcagacacatatggtaattccatgttttttcatttacgcagggagcaaatctttgctaggcactattataataaacttgtaggtgttggggaagacattcctaacgattattatattaagggtagtggtaatggccgtgaccctatagaaagttatatatactctgctactcccagtgggtctatgataacatctgattctcaaatttttaataagccttattggctccaccgtgcgcagggtcacaataatggcatttgctggaacaatcagctttttattacctgtgttgatactaccagaagtacaaatttaactattagcactgccactgctgcggtttccccaacatttactccaagtaactttaagcaatatattaggcatggggaagagtatgaattgcaatttatttttcaattatgtaaaattactctgactacagaggtaatggcttatttacacacaatggatcctaccattcttgaacagtggaattttggattaacattacctccgtctgctagtttggaggatgcatataggtttgttagaaatgcagctactagctgtcaaaaggacacccctccacaggctaagccagatcctttggccaaatataaattttgggatgttgatttaaaggaacgattttctttagatttagaccaatttgcattgggtcgcaagtttttgttgcaggttggcgtacaacgcaagcccagaccaggccttaaacgcccggcctcatcggcatcctcttcctcttcctcttcagccaaacgtaaacgtgttaaaaag

SEQ ID NO: 11 - DNA, 1509 bp, Human papillomavirus
atgtccgtgtggcggcctagtgaggccactgtgtacctgcctcctgtacctgtctctaaggttgtaagcactgatgagtatgtgtctcgcacaagcatctattattatgcaggcagttctcgattactaacagtaggacatccctatttttctattaaaaacaccagtagtggtaatggtaaaaaagttttagttcccaaggtgtctggcctgcaatacagggtatttagaattaaattgccggaccctaataaatttggttttccagatacatctttttataacccagaaacccaaaggttggtgtgggcctgtacaggcttggaaattggtaggggacagcctttaggtgtgggtattagtgggcatcctttattaaacaagtttgatgatactgaaaccagtaacaaatatgctggtaaacctggtatagataatagggaatgtttatctatggattataagcagactcagttatgcattttaggatgcaaacctcctataggtgaacattggggtaagggaaccccttgtaataataattcaggaaatcctggggattgtcctcccctacagctcattaacagtgtaatacaggatggggacatggtagatacaggatttggttgcatggattttaataccttgcaagctagtaaaagtgatgtgcccattgatatatgtagcagtgtatgtaagtatccagattatttgcaaatggctagcgagccatatggtgacagtttgttcttttttcttagacgtgagcaaatgtttgttagacacttttttaatagggccggtaccttaggtgaccctgtgccaggtgatttatatatacaagggtctaactctggcaatactgccactgtacaaagcagtgctttttttcctactcctagtggttctatggtaacctcagaatcccaattatttaataaaccgtactggttacaacgtgcgcagggccacaataatggcatatgttggggcaatcagttgtttgtcacagttgtggataccactcgtagcactaacatgactttatgtgctgaggttaaaaaggaaagcacatataaaaatgaaaattttaaggaataccttcgtcatggcgaggaatttgatttacagtttatttttcagttgtgcaaaattacattaacagctgatgttatgacatacattcataagatggatgccactattttagaggactggcaatttggccttaccccaccaccgtctgcatctttggaggacacatacagatttgtcacttctactgctataacttgtcaaaaaaacacaccacctaaaggaaaggaagatcctttaaaggactatatgttttgggaggtggatttaaaagaaaagttttctgcagatttagatcagtttcctttaggtaggaagtttttgttacaggcagggctacaggctaggcccaaactaaaacgccctgcatcatcggccccacgtacctccacaaagaagaaaaaggttaaaagg

SEQ ID NO: 12 - DNA, 1497 bp, Human papillomavirus
atggcgacgtggcggcctagtgaaaataaggtgtatctacctccaacacctgtttcaaaggttgtggcaacggattcctatgtaaaacgcactagtatattttatcatgcaggcagttcacgattgcttgccgtaggacatccctattactctgtgactaaggacaataccaaaacaaacattcccaaagttagtgcatatcaatatagggtatttagggtacggttgcccgaccctaataagtttgggcttccagatactaatatttataatccggaccaggaacggttagtgtgggcatgtgtaggtttggaggtaggccgcggacagcctttaggtgctgggctaagtggccatccattgtttaataggctggatgatactgaaagttccaatttagcaaataataatgttatagaagatagtagggacaatatatcagttgatggcaagcaaacacagttgtgtattgttggatgtactcccgctatgggtgaacattggactaaaggtgctgtgtgtaagtccacacaagttaccacaggggactgcccgcctcttgcattaattaatacacctatagaggatggggacatgatagacacaggatttggcgctatggactttaaggtgttgcaggaatctaaggctgaggtacctttagacattgtacaatccacctgtaaatatcctgactatttaaaaatgtctgcagatgcctatggtgattctatgtggttttacttacgcagggaacaattatttgccagacattattttaatagggctggtaaagttggggaaacaatacctgcagagttatatttaaagggtagcaatggtagagaaccccctccgagttctgtatatgttgctacgcctagtgggtctatgattacgtctgaggcacagttatttaataaaccttattggttgcaacgtgcccaaggccataataatggcatttgctggggtaatcaattatttgttactgtagtagatactactagaagtactaacatgactattagtactgctacagaacagctcagtaaatatgatgcacgaaaaattaatcagtaccttagacatgtggaggaatatgaattacaatttgtttttcaattatgcaaaattactttgtctgcagaggttatggcatatttacataatatgaatgctaacctactggaggactggaatattgggttatccccgccagtggccaccagcctagaagataaatatagatatgttagaagcacagctataacatgtcaacgggaacagccaccaacagaaaaacaggacccattagctaaatataaattttgggatgttaacttacaggacagtttttctacagacctggatcaatttccactgggtagaaaatttttaatgcaactgggcactaggtcaaagcctgctgtagctacctctaaaaagcgatctgctcctacctccacctctacaccagcaaaacgtaaaaggcgg

SEQ ID NO: 13 - DNA, 1494 bp, Human papillomavirus
atgtccgtgtggcggcctagtgaggccactgtgtacctgcctcctgtgcctgtgtctaaggttgtaagcactgatgaatatgtgtcacgcacaagcatttattattatgctggcagttccagacttttggctgttggcaatccatatttttccatcaaaagtcccaataacaataaaaaagtattagttcccaaggtatcaggcttacagtatagggtctttagggtgcgtttacctgatcccaataaatttggttttcctgatacatctttttataaccctgatacacaacgtttggtctgggcatgtgtaggccttgaaataggtaggggacagccattgggtgttggcgtaagtggtcatccttatttaaataaatttgatgacactgaaaccagtaacagatatcccgcacagccagggtctgataacagggaatgcttatctatggattataaacaaacacaattatgtttaattggctgtaaacctcccactggtgagcattggggtaaaggtgttgcctgtaacaataatgcagctgctactgattgtcctccattggaactttttaattctattattgaggatggtgacatggtagatacagggtttggatgcatggactttggtacattgcaggctaataaaagtgatgtgcctattgatatttgtaacagtacatgcaaatatccagattatttaaaaatggccagtgaaccttatggggatagtttgttcttttttcttagacgtgagcagatgtttgttagacacttttttaatagggctggaaaacttggcgaggctgtcccggatgacctttatattaaagggtccggtaatactgcagttatccaaagtagtgcattttttccaactcctagtggctctatagttacctcagaatcacaattatttaataagccttattggctacagcgtgcacaaggtcataacaatggcatttgctggggcaatcagttatttgttaccgtggttgataccactcgtagcactaatatgacattatgcactgaagtaactaaggaaggtacatataaaaatgataattttaaggaatatgtacgtcatgttgaagaatatgacctacagtttgtttttcagctttgcaaaattacactaactgcagagataatgacatatatacatactatggattccaatattttggaggactggcaatttggtttaacacctcctccgtctgccagtttacaggacacatatagatttgttacctcccaggctattacttgccaaaaaacagcaccccctaaagaaaaggaagatccattaaataaatatactttttgggaggttaacttaaaggaaaagttttctgcagatcttgatcagtttcctttgggacgaaagtttttattacaatcaggccttaaagcaaagcccagactaaaacgttcggcccctactacccgtgcaccatccaccaaacgcaaaaaggttaaaaaa

SEQ ID NO: 14 - DNA, 1524 bp, Human papillomavirus
atggctctatggcgttctagtgacaacaaggtgtatctacctccaccttcggtagctaaggttgtcagcactgatgagtatgtcacccgtaccagtattttctaccacgcaggcagttccagacttcttacagttggacatccatattttaaagtacctaaaggtggtaatggtagacaggatgttcctaaggtgtctgcatatcaatacagagtatttagggttaagttacctgatcccaataaatttggccttccagataacacagtatatgatcctaactctcaacgcttggtctgggcctgtgtaggtgttgaaatcggtcggggccaacctttaggggtaggactcagtggtcatccattatataataaattggatgacactgaaaactctcatgtagcatctgctgttgataccaaagatacacgtgataatgtatctgtggattataaacaaactcagctgtgtattattggctgtgtacctgccattggagaacactggacaaagggcactgcttgtaagcctactactgtggttcagggcgattgtcctccactagaattaataaatacaccaattgaagatggtgatatggtagacacaggatatggggctatggactttaaattgttgcaggataacaaaagtgaagtaccattggatatttgtcagtctatttgtaaatatcctgattatttacaaatgtcagcagatgcttatggagacagtatgtttttttgtttaaggcgagaacaggtttttgccagacatttttggaatagatctggtactatgggtgatcaacttcctgaatcactatatattaaaggtactgacatacgtgccaacccaggcagttatttatattccccttccccaagtgggtctgtggttacttctgattcacaattatttaataaaccatattggctgcacaaggctcagggtttaaacaatggtatatgttggcacaatcaattgtttttaacagttgtagatactactcgcagcaccaatctttctgtgtgtgcttctactacttcttctattcctaatgtatacacacctaccagttttaaagaatatgccagacatgtggaggaatttgatttgcagtttatatttcagctgtgtaaaataacattaactacagaggtaatgtcatacattcataatatgaataccactattttggaggattggaattttggtgttacaccacctcctactgctagtttagttgacacataccgttttgttcaatctgctgctgtaacttgtcaaaaggacaccgcaccgccagttaaacaggacccttatgacaaactaaagttttggcctgtagatcttaaggaaaggttttctgcagatcttgatcagtttcctttgggacgtaaatttttattgcaattaggagctagacctaagcccactataggcccacgcaaacgtgcagcgcctgcccctacctctaccccatcaccaaaacgtgttaagcgtcgcaagtcttccagaaaa

SEQ ID NO: 15 - DNA, 1515 bp, Human papillomavirus
atggcattgtggcgagctagcgacaacatggtgtatttgcctcccccctcagtggcgaaggttgtcaatacagatgattatgtgacacgcactggcatgtattactatgctggtacatctaggttattaactgtaggccatccatattttaaggttcctatgtctgggggccgcaagcagggcattcctaaggtgtctgcatatcaatacagagtgtttagggttaccttacctgatcctaataaatttagtgttcctgagtctacattatataatccagatacacagcgcatggtatgggcctgtgttggtgttgaaataggtagggggcagccattgggcgttggccttagtgggcatccactatataataggctggatgatactgaaaattccccgttttcctctaataaaaatcctaaagatagtagggacaatgttgcagtggactgtaaacaaacacagctgtgtattataggctgtgttcctgctattggagagcactgggccaaaggtaaatcttgtaagcctaccaatgtacaacaaggggactgtcccccattggaattggtaaatactcctattgaggatggcgatatgattgatacaggatatggtgctatggactttggtacattacaagaaacgaaaagcgaggtacctttggatatatgtcaatctgtttgcaaatatcctgactatttgcaaatgtctgcagatgtgtatggagacagtatgtttttttgtttacgtagggaacagttatttgccaggcatttttggaataggggaggcatggtaggggacactattcccactgacatgtatattaagggcactgacattcgtgaaactcctagtagttatgtgtatgccccctcgcctagcgggtctatggtgtcctctgactcccagttatttaacaagccctattggctgcacaaggcacagggacacaacaatggtatttgttggcataatcaattatttcttaccgttgtggatacaacgcgcagtactaattttacattgtccactactacagactctactgtaccagctgtgtatgattctaataaatttaaggaatatgttaggcatgttgaggaatatgatttgcagtttatatttcagttgtgtactataacattatccactgacgtaatgtcatatatacatactatgaatcctgctattttggatgattggaattttggtgttgcccctccaccatctgctagtcttgtagatacataccgctacctacaatcagcagcaattacatgtcaaaaggacgcccctgcacctgttaaaaaagatccctatgatggtcttaacttttggaatgtggatttaaaggaaaagtttagttctgaactggaccaattcccattaggacgcaaatttctgttacaggcaggtgttcgcagacggcccaccataggccctcgtaaacgcactgccactgcagctaccacatctacctctaaacacaaacgtaaacgtgtgtcaaaa

SEQ ID NO: 16 - DNA, 1509 bp, Human papillomavirus
atgtggcgacctactgatgcaaaggtatacctgccccctgtgtctgtgtctaaggttgtaagcacagatgaatatgtaacaagaacaaatatatattattatgcaggtagcacacgtttgttggctgtgggacacccatattttcctatcaaggattctcaaaaacgtaaaaccatagttcctaaagtttcaggtttgcaatacagggtgtttaggcttcgtttaccagatcctaataaatttggatttccagatgcatccttttataatcctgataaggagcgcctagtatgggcctgttctggtgtggaggttggacgtggacaacccttaggtataggtactagtggcaatccatttatgaataaattagatgatactgaaaatgctcctaaatacattgctggacaaaatacagatggtagagaatgtatgtcagtggattataaacaaacacagttgtgtattttaggttgtaggcctcccttaggggaacattggggtccaggcacgccatgtacttcacaaactgttaatactggtgattgtcccccactggaattaaagaacacccctatacaggatggtgatatgatagatgttggctttggagccatggattttaaagctttacaagcaaataaaagtgatgtacctattgatatttctaacactacctgtaaatacccagattatttaggcatggctgctgatccctatggtgattccatgtggttttatcttcgtagggaacaaatgtttgttcgacacttatttaacagggctggtgataccggtgataaaatcccagatgacctaatgattaaaggcacaggcaatactgcaacaccatccagttgtgttttttatcctacacctagtggttccatggtttcttcagatgcacagttgtttaataaaccttattggttgcaaaaggcacagggacaaaataatggtatttgttggcataatcaattatttttaactgttgtagatactactagaagcactaatttttctgtatgtgtaggtacacaggctagtagctctactacaacgtatgccaactctaattttaaggaatatttaagacatgcagaagagtttgacttacagtttgtttttcagttatgtaaaattagtttaaccactgaggtgatgacatatatccattctatgaattctactatattggaagagtggaattttggtcttaccccaccaccgtcaggtactttagaggaaacatatagatatgtaacatcacaggctattagttgccaacgtcctcaacctcctaaagaaacagaggacccatatgccaagctatccttttgggatgtagatcttaaggaaaagttttctgcagaattagaccagtttcctttgggaagaaaatttttattacaacttggtatgcgtgcacgtcctaagttacaagcttctaaacgttctgcatctgctaccacaagtgccacacctaagaaaaaacgtgctaaacgtatt

SEQ ID NO: 17 - DNA, 1509 bp, Human papillomavirus
atggctttgtggcgtactaatgacagcaaagtgtatttaccacctgcaccagtgtcacgcattgtcaacacagaagaatatataacccgcaccggcatatattattatgcaggcagttccagacttattaccttaggacatccatatttttcaatacccaaaaccaatacacgtgctgaaatacctaaggtatctgcctttcagtatagggtgtttagggtacagttacctgaccccaacaaatttggtcttcctgatcctaatttgtttaatccagacacagatcgtttggtgtggggatgtgttggtgttgaagtaggtaggggtcagccgttaggtgttggccttagtggtcatcctttatttaataagtatgatgatactgaaaactctaggtttgccaatggcaacgaccaacaggatgttagggacaacatatctgtggacaacaaacaaactcagttatgcattataggctgcgctcctcctattggggaacactgggccacaggtaccacatgtaaaaacgtacctgtacctcagggtgactgtccacctttggaacttgtgtctactgtcattgaggatggcgatatggtggacactggttttggggccatggattttgctaatttacaagctactaaatcagatgttccattggatattgctcagtctgtgtgtaaataccctgattacttaaaaatgtcagcagatacatatggcaattctatgttttttcatttacgcagggagcaaatatttgctaggcattactataataaggctggtgtggttggtgatgccattccagacaaggcttatattaagggtactggtgctggccgcgaccctattagtagttatatttattcagctactcccagtggttctatgataacctctgattctcagatttttaataagccttattggttgcatcgcgcccagggccacaataatggcatttgctggaataatcagctttttattacttgtgttgacactactaaaagtaccaatttaaccattagcactgctgttactccatctgttgcacaaacatttactccagcaaactttaagcagtacattaggcatggggaagaatatgaattgcaatttatatttcaattgtgtaaaatcactttaactactgaaattatggcttacctgcacaccatggattctacaattttagaacagtggaattttggattaacattgcccccctccgctagtttggaggatgcctatcgatttgtaaaaaatgcagcaacatcctgtcacaaggacagtcctccacaggctaaagaagaccctttggcaaaatataaattttggaatgtagaccttaaggaacgcttttctttggatttggatcagtttgcattgggtcgcaagtttttattacaaatcggtgcccaacgcaaacccagaccaggccttaaaaggcctgccccatcctcttccgcttcctcgtctgccaaacgtaaaagggttaaaaaa

SEQ ID NO: 18 - DNA, 372 bp, Artificial Sequence
  Synthetic Polynucleotide
atggagacccccgcccagctgctgttcctgctgctgctgtggctgcccgacaccaccggccacggccccaaggccaccctgcaggacatcgtgctgcacctggagccccagaacgagatccccgtggacctgctgggccacggccagctgagcgacagcgaggaggagaacgacgagatcgacggcgtgaaccaccagcacctgcccgccagaagagccgagccccagagacacaccatgctgtgcatgtgctgcaagtgcgaggccagaatcaagctggtggtggagagcagcgccgacgacctgagagccttccagcagctgttcctgaacaccctgagcttcgtgtgcccctggtgcgccagccagcag

SEQ ID NO: 19 - DNA, 315 bp, Artificial Sequence
  Synthetic Polynucleotide
atgcacggccccaaggccaccctgcaggacatcgtgctgcacctggagccccagaacgagatccccgtggacctgctgggccacggccagctgagcgacagcgaggaggagaacgacgagatcgacggcgtgaaccaccagcacctgcccgccagaagagccgagccccagagacacaccatgctgtgcatgtgctgcaagtgcgaggccagaatcaagctggtggtggagagcagcgccgacgacctgagagccttccagcagctgttcctgaacaccctgagcttcgtgtgcccctggtgcgccagccagcag

SEQ ID NO: 20 - DNA, 351 bp, Artificial Sequence
  Synthetic Polynucleotide
atggagacccccgcccagctgctgttcctgctgctgctgtggctgcccgacaccaccggccacggcgacacccccaccctgcacgagtacatgctggacctgcagcccgagaccaccgacctgtacggctacggccagctgaacgacagcagcgaggaggaggacgagatcgacggccccgccggccaggccgagcccgacagagcccactacaacatcgtgaccttctgctgcaagtgcgacagcaccctgagactgtgcgtgcagagcacccacgtggacatcagaaccctggaggacctgctgatgggcaccctgggcatcgtgtgccccatctgcagccagaagccc

SEQ ID NO: 21 - DNA, 294 bp, Artificial Sequence
  Synthetic Polynucleotide
atgcacggcgacacccccaccctgcacgagtacatgctggacctgcagcccgagaccaccgacctgtacggctacggccagctgaacgacagcagcgaggaggaggacgagatcgacggccccgccggccaggccgagcccgacagagcccactacaacatcgtgaccttctgctgcaagtgcgacagcaccctgagactgtgcgtgcagagcacccacgtggacatcagaaccctggaggacctgctgatgggcaccctgggcatcgtgtgccccatctgcagccagaagccc

SEQ ID NO: 22 - DNA, 507 bp, Artificial Sequence
  Synthetic Polynucleotide
atggagacccccgcccagctgctgttcctgctgctgctgtggctgcccgacaccaccggcgccagattcgaggaccccaccagaagcggctacaagctgcccgacctgtgcaccgagctgaacaccagcctgcaggacatcgagatcacctgcgtgtactgcaagaccgtgctggagctgaccgaggtgttcgagaaggacctgttcgtggtgtacagagacagcatcccccacgccgcctgccacaagtgcatcgacttctacagcagaatcagagagctgagacactacagcgacagcgtgtacggcgacaccctggagaagctgaccaacaccggcctgtacaacctgctgatcagatgcctgagatgccagaagcccctgctgagacacctgaacgagaagagaagattccacaacatcgccggccactacagaggccagtgccacagctgctgcaacagagccagacaggagagactgcagagaagaagagagacccaggtg

SEQ ID NO: 23 - DNA, 450 bp, Artificial Sequence
  Synthetic Polynucleotide
atggccagattcgaggaccccaccagaagcggctacaagctgcccgacctgtgcaccgagctgaacaccagcctgcaggacatcgagatcacctgcgtgtactgcaagaccgtgctggagctgaccgaggtgttcgagaaggacctgttcgtggtgtacagagacagcatcccccacgccgcctgccacaagtgcatcgacttctacagcagaatcagagagctgagacactacagcgacagcgtgtacggcgacaccctggagaagctgaccaacaccggcctgtacaacctgctgatcagatgcctgagatgccagaagcccctgctgagacacctgaacgagaagagaagattccacaacatcgccggccactacagaggccagtgccacagctgctgcaacagagccagacaggagagactgcagagaagaagagagacccaggtg

SEQ ID NO: 24 - DNA, 507 bp, Artificial Sequence
  Synthetic Polynucleotide
atggagacccccgcccagctgctgttcctgctgctgctgtggctgcccgacaccaccggccaccagaagagaaccgccatgttccaggacccccaggagagcggcagaaagctgccccagctgtgcaccgagctgcagaccaccatccacgacatcatcctggagtgcgtgtactgcaagcagcagctgctgagaagagaggtgtacgacagagacctgtgcatcgtgtacagagacggcaacccctacgccgtgtgcgacaagtgcctgaagttctacagcaagatcagcgagtacagacactactgctacagcctgtacggcaccaccctggagcagcagtacaacaagcccctgtgcgacctgctgatcagatgcatcaactgccagaagcccctgcagagacacctggacaagaagcagagattccacaacatcagaggcagatggaccggcagatgcatgagctgctgcagaagcagcagaaccagaagagagacccagctg

SEQ ID NO: 25 - DNA, 315 bp, Artificial Sequence
  Synthetic Polynucleotide
atgcatggacctaaggcaacattgcaagacattgtattgcatttagagccccaaaatgaaattccggttgaccttctatgtcacgagcaattaagcgactcagaggaagaaaacgatgaaatagatggagttaatcatcaacatttaccagcccgacgagccgaaccacaacgtcacacaatgttgtgtatgtgttgtaagtgtgaagccagaattgagctagtagtagaaagctcagcagacgaccttcgagcattccagcagctgtttctgaacaccctgtcctttgtgtgtccgtggtgtgcatcccagcag

SEQ ID NO: 26 - DNA, 294 bp, Artificial Sequence
  Synthetic Polynucleotide
atgcatggagatacacctacattgcatgaatatatgttagatttgcaaccagagacaactgatctctactgttatgagcaattaaatgacagctcagaggaggaggatgaaatagatggtccagctggacaagcagaaccggacagagcccattacaatattgtaaccttttgttgcaagtgtgactctacgcttcggttgtgcgtacaaagcacacacgtagacattcgtactttggaagacctgttaatgggcacactaggaattgtgtgccccatctgttctcagaaacca

SEQ ID NO: 27 - DNA, 474 bp, Human papillomavirus
atggcgcgctttgaggatccaacacggcgaccctacaagctacctgatctgtgcacggaactgaacacttcactgcaagacatagaaataacctgtgtatattgcaagacagtattggaacttacagaggtatttgaatttgcatttaaagatttatttgtggtgtatagagacagtataccccatgctgcatgccataaatgtatagatttttattccagaattagagaattaagacattattcagactctgtgtatggagacacattggaaaaactaactaacactgggttatacaatttattaataaggtgcctgcggtgccagaaaccgttgaatccagcagaaaaacttagacaccttaatgaaaaacgacgatttcacaacatagctgggcactatagaggccagtgccattcgtgctgcaaccgagcacgacaggaacgactccaacgacgcagagaaacacaagta

SEQ ID NO: 28 - DNA, 474 bp, Human papillomavirus
atgcaccaaaagagaactgcaatgtttcaggacccacaggagcgacccagaaagttaccacagttatgcacagagctgcaaacaactatacatgatataatattagaatgtgtgtactgcaagcaacagttactgcgacgtgaggtatatgactttgcttttcgggatttatgcatagtatatagagatgggaatccatatgctgtatgtgataaatgtttaaagttttattctaaaattagtgagtatagacattattgttatagtttgtatggaacaacattagaacagcaatacaacaaaccgttgtgtgatttgttaattaggtgtattaactgtcaaaagccactgtgtcctgaagaaaagcaaagacatctggacaaaaagcaaagattccataatataaggggtcggtggaccggtcgatgtatgtcttgttgcagatcatcaagaacacgtagagaaacccagctg

SEQ ID NO: 29 - DNA, 423 bp, Human papillomavirus
atgtggcttcaaaatctcttgtttcttggaatcgtcgtgtacagcctgtcagccccaactagatcgcctatcactgtgacgcgcccgtggaagcacgtggaagccatcaaggaggctctgaatctgctcgacgatatgccagtgaccctgaacgaggaagtcgaagtggtgtccaacgaattttccttcaaaaagttgacctgtgttcagacccggctgaagattttcgagcagggcctcaggggaaacttcaccaaactgaagggtgcactgaacatgaccgccagctactaccagacctattgccctccgactccggaaactgattgcgagactcaagtcaccacctacgcggacttcatcgactcgctcaagacgttcctgactgacatccccttcgagtgcaagaagccggggcagaaa

SEQ ID NO: 30 - DNA, 429 bp, Human papillomavirus
atgtggctacagtctctcctgctcctgggaaccgtggcttgcagcatatcagcgcctgccaggagccccagcccatctacccagccatgggagcacgtaaacgccatacaggaagcccggcggctgcttaatctatcccgcgatacagcagccgaaatgaacgaaaccgtggaggtcatcagtgagatgtttgatctacaagagcctacttgcttacaaacccgcctagagctttacaagcaaggcctccggggctctctcacaaagctgaaaggtccattaactatgatggcctcccactataaacagcactgcccacctacaccagagacctcctgtgccacccagattataaccttcgaaagctttaaggagaatttaaaggatttcctcctggtcatccccttcgactgctgggaaccagtccag

SEQ ID NO: 31 - protein, 500 aa, Human papillomavirus
MWRPSDSTVYVPPPNPVSKVVATDAYVTRTNIFYHASSSRLLAVGHPYFSIKRANKTVVPKVSGYQYRVFKVVLPDPNKFALPDSSLFDPTTQRLVWACTGLEVGRGQPLGVGVSGHPFLNKYDDVENSGSGGNPGQDNRVNVGMDYKQTQLCMVGCAPPLGEHWGKGKQCTNTPVQAGDCPPLELITSVIQDGDMVDTGFGAMNFADLQTNKSDVPIDICGTTCKYPDYLQMAADPYGDRLFFFLRKEQMFARHFFNRAGEVGEPVPDTLIIKGSGNRTSVGSSIYVNTPSGSLVSSEAQLFNKPYWLQKAQGHNNGICWGNQLFVTVVDTTRSTNMTLCASVTTSSTYTNSDYKEYMRHVEEYDLQFIFQLCSITLSAEVMAYIHTMNPSVLEDWNFGLSPPPNGTLEDTYRYVQSQAITCQKPTPEKEKPDPYKNLSFWEVNLKEKFSSELDQYPLGRKFLLQSGYRGRSSIRTGVKRPAVSKASAAPKRKRAKTKR

SEQ ID NO: 32 - protein, 501 aa, Human papillomavirus
MWRPSDSTVYVPPPNPVSKVVATDAYVKRTNIFYHASSSRLLAVGHPYYSIKKVNKTVVPKVSGYQYRVFKVVLPDPNKFALPDSSLFDPTTQRLVWACTGLEVGRGQPLGVGVSGHPLLNKYDDVENSGGYGGNPGQDNRVNVGMDYKQTQLCMVGCAPPLGEHWGKGTQCSNTSVQNGDCPPLELITSVIQDGDMVDTGFGAMNFADLQTNKSDVPLDICGTVCKYPDYLQMAADPYGDRLFFYLRKEQMFARHFFNRAGTVGEPVPDDLLVKGGNNRSSVASSIYVHTPSGSLVSSEAQLFNKPYWLQKAQGHNNGICWGNHLFVTVVDTTRSTNMTLCASVSKSATYTNSDYKEYMRHVEEFDLQFIFQLCSITLSAEVMAYIHTMNPSVLEDWNFGLSPPPNGTLEDTYRYVQSQAITCQKPTPEKEKQDPYKDMSFWEVNLKEKFSSELDQFPLGRKFLLQSGYRGRTSARTGIKRPAVSKPSTAPKRKRTKTKK

SEQ ID NO: 33 - protein, 505 aa, Human papillomavirus
MSLWLPSEATVYLPPVPVSKVVSTDEYVARTNIYYHAGTSRLLAVGHPYFPIKKPNNNKILVPKVSGLQYRVFRIHLPDPNKFGFPDTSFYNPDTQRLVWACVGVEVGRGQPLGVGISGHPLLNKLDDTENASAYAANAGVDNRECISMDYKQTQLCLIGCKPPIGEHWGKGSPCTNVAVNPGDCPPLELINTVIQDGDMVDTGFGAMDFTTLQANKSEVPLDICTSICKYPDYIKMVSEPYGDSLFFYLRREQMFVRHLFNRAGTVGENVPDDLYIKGSGSTANLASSNYFPTPSGSMVTSDAQIFNKPYWLQRAQGHNNGICWGNQLFVTVVDTTRSTNMSLCAAISTSETTYKNTNFKEYLRHGEEYDLQFIFQLCKITLTADVMTYIHSMNSTILEDWNFGLQPPPGGTLEDTYRFVTSQAIACQKHTPPAPKEDPLKKYTFWEVNLKEKFSADLDQFPLGRKFLLQAGLKAKPKFTLGKRKATPTTSSTSTTAKRKKRKL

SEQ ID NO: 34 - protein, 507 aa, Human papillomavirus
MALWRPSDNTVYLPPPSVARVVNTDDYVTRTSIFYHAGSSRLLTVGNPYFRVPAGGGNKQDIPKVSAYQYRVFRVQLPDPNKFGLPDTSIYNPETQRLVWACAGVEIGRGQPLGVGLSGHPFYNKLDDTESSHAATSNVSEDVRDNVSVDYKQTQLCILGCAPAIGEHWAKGTACKSRPLSQGDCPPLELKNTVLEDGDMVDTGYGAMDFSTLQDTKCEVPLDICQSICKYPDYLQMSADPYGDSMFFCLRREQLFARHFWNRAGTMGDTVPQSLYIKGTGMRASPGSCVYSPSPSGSIVTSDSQLFNKPYWLHKAQGHNNGVCWHNQLFVTVVDTTRSTNLTICASTQSPVPGQYDATKFKQYSRHVEEYDLQFIFQLCTITLTADVMSYIHSMNSSILEDWNFGVPPPPTTSLVDTYRFVQSVAITCQKDAAPAENKDPYDKLKFWNVDLKEKFSLDLDQYPLGRKFLVQAGLRRKPTIGPRKRSAPSATTSSKPAKRVRVRARK

SEQ ID NO: 35 - protein, 504 aa, Human papillomavirus
MSLWRPSEATVYLPPVPVSKVVSTDEYVTRTNIYYHAGSARLLTVGHPYYSIPKSDNPKKIVVPKVSGLQYRVFRVRLPDPNKFGFPDTSFYNPETQRLVWACVGLEVGRGQPLGVGISGHPLLNKFDDTENSNRYAGGPGTDNRECISMDYKQTQLCLLGCKPPIGEHWGKGSPCSNNAITPGDCPPLELKNSVIQDGDMVDTGFGAMDFTALQDTKSNVPLDICNSICKYPDYLKMVAEPYGDTLFFYLRREQMFVRHFFNRSGTVGESVPTDLYIKGSGSTATLANSTYFPTPSGSMVTSDAQIFNKPYWMQRAQGHNNGICWGNQLFVTVVDTTRSTNMSVCAAIANSDTTFKSSNFKEYLRHGEEFDLQFIFQLCKITLSADIMTYIHSMNPAILEDWNFGLTTPPSGSLEDTYRFVTSQAITCQKTAPQKPKEDPFKDYVFWEVNLKEKFSADLDQFPLGRKFLLQAGYRARPKFKAGKRSAPSASTTTPAKRKKTKK

SEQ ID NO: 36 - protein, 499 aa, Human papillomavirus
MSVWRPSEATVYLPPVPVSKVVSTDEYVSRTSIYYYAGSSRLLAVGHPYFSIKNPTNAKKLLVPKVSGLQYRVFRVRLPDPNKFGFPDTSFYNPDTQRLVWACVGLEIGRGQPLGVGISGHPLLNKFDDTETGNKYPGQPGADNRECLSMDYKQTQLCLLGCKPPTGEHWGKGVACTNAAPANDCPPLELINTIIEDGDMVDTGFGCMDFKTLQANKSDVPIDICGSTCKYPDYLKMTSEPYGDSLFFFLRREQMFVRHFFNRAGTLGEAVPDDLYIKGSGTTASIQSSAFFPTPSGSMVTSESQLFNKPYWLQRAQGHNNGICWGNQVFVTVVDTTRSTNMTLCTQVTSDSTYKNENFKEYIRHVEEYDLQFVFQLCKVTLTAEVMTYIHAMNPDILEDWQFGLTPPPSASLQDTYRFVTSQAITCQKTVPPKEKEDPLGKYTFWEVDLKEKFSADLDQFPLGRKFLLQAGLKAKPKLKRAAPTSTRTSSAKRKKVKK

SEQ ID NO: 37 - protein, 502 aa, Human papillomavirus
MSLWRSNEATVYLPPVSVSKVVSTDEYVTRTNIYYHAGSSRLLAVGHPYYAIKKQDSNKIAVPKVSGLQYRVFRVKLPDPNKFGFPDTSFYDPASQRLVWACTGVEVGRGQPLGVGISGHPLLNKLDDTENSNKYVGNSGTDNRECISMDYKQTQLCLIGCRPPIGEHWGKGTPCNANQVKAGECPPLELLNTVLQDGDMVDTGFGAMDFTTLQANKSDVPLDICSSICKYPDYLKMVSEPYGDMLFFYLRREQMFVRHLFNRAGTVGETVPADLYIKGTTGTLPSTSYFPTPSGSMVTSDAQIFNKPYWLQRAQGHNNGICWSNQLFVTVVDTTRSTNMSVCSAVSSSDSTYKNDNFKEYLRHGEEYDLQFIFQLCKITLTADVMTYIHSMNPSILEDWNFGLTPPPSGTLEDTYRYVTSQAVTCQKPSAPKPKDDPLKNYTFWEVDLKEKFSADLDQFPLGRKFLLQAGLKARPNFRLGKRAAPASTSKKSSTKRRKVKS

SEQ ID NO: 38 - protein, 505 aa, Human papillomavirus
MAMWRSSDSMVYLPPPSVAKVVNTDDYVTRTGIYYYAGSSRLLTVGHPYFKVGMNGGRKQDIPKVSAYQYRVFRVTLPDPNKFSIPDASLYNPETQRLVWACVGVEVGRGQPLGVGISGHPLYNRQDDTENSPFSSTTNKDSRDNVSVDYKQTQLCIIGCVPAIGEHWGKGKACKPNNVSTGDCPPLELVNTPIEDGDMIDTGYGAMDFGALQETKSEVPLDICQSICKYPDYLQMSADVYGDSMFFCLRREQLFARHFWNRGGMVGDAIPAQLYIKGTDIRANPGSSVYCPSPSGSMVTSDSQLFNKPYWLHKAQGHNNGICWHNQLFLTVVDTTRSTNFTLSTSIESSIPSTYDPSKFKEYTRHVEEYDLQFIFQLCTVTLTTDVMSYIHTMNSSILDNWNFAVAPPPSASLVDTYRYLQSAAITCQKDAPAPEKKDPYDGLKFWNVDLREKFSLELDQFPLGRKFLLQARVRRRPTIGPRKRPAASTSSSSATKHKRKRVSK

SEQ ID NO: 39 - protein, 513 aa, Human papillomavirus
MALWRPSDSTVYLPPPSVARVVSTDDYVSRTSIFYHAGSSRLLTVGNPYFRVVPNGAGNKQAVPKVSAYQYRVFRVALPDPNKFGLPDSTIYNPETQRLVWACVGMEIGRGQPLGIGLSGHPFYNKLDDTESAHAATAVITQDVRDNVSVDYKQTQLCILGCVPAIGEHWAKGTLCKPAQLQPGDCPPLELKNTIIEDGDMVDTGYGAMDFSTLQDTKCEVPLDICQSICKYPDYLQMSADPYGDSMFFCLRREQLFARHFWNRAGVMGDTVPTDLYIKGTSANMRETPGSCVYSPSPSGSIITSDSQLFNKPYWLHKAQGHNNGICWHNQLFVTVVDTTRSTNLTLCASTQNPVPSTYDPTKFKQYSRHVEEYDLQFIFQLCTITLTAEVMSYIHSMNSSILENWNFGVPPPPTTSLVDTYRFVQSVAVTCQKDTTPPEKQDPYDKLKFWTVDLKEKFSSDLDQYPLGRKFLVQAGLRRRPTIGPRKRPAASTSTASTASRPAKRVRIRSKK

SEQ ID NO: 40 - protein, 504 aa, Human papillomavirus
MALWRTNDSKVYLPPAPVSRIVNTEEYITRTGIYYYAGSSRLITLGHPYFPIPKTSTRAAIPKVSAFQYRVFRVQLPDPNKFGLPDPNLYNPDTDRLVWGCVGVEVGRGQPLGVGLSGHPLFNKYDDTENSRIANGNAQQDVRDNTSVDNKQTQLCIIGCAPPIGEHWGIGTTCKNTPVPPGDCPPLELVSSVIQDGDMIDTGFGAMDFAALQATKSDVPLDISQSVCKYPDYLKMSADTYGNSMFFHLRREQIFARHYYNKLVGVGEDIPNDYYIKGSGNGRDPIESYIYSATPSGSMITSDSQIFNKPYWLHRAQGHNNGICWNNQLFITCVDTTRSTNLTISTATAAVSPTFTPSNFKQYIRHGEEYELQFIFQLCKITLTTEVMAYLHTMDPTILEQWNFGLTLPPSASLEDAYRFVRNAATSCQKDTPPQAKPDPLAKYKFWDVDLKERFSLDLDQFALGRKFLLQVGVQRKPRPGLKRPASSASSSSSSSAKRKRVKK

SEQ ID NO: 41 - protein, 503 aa, Human papillomavirus
MSVWRPSEATVYLPPVPVSKVVSTDEYVSRTSIYYYAGSSRLLTVGHPYFSIKNTSSGNGKKVLVPKVSGLQYRVFRIKLPDPNKFGFPDTSFYNPETQRLVWACTGLEIGRGQPLGVGISGHPLLNKFDDTETSNKYAGKPGIDNRECLSMDYKQTQLCILGCKPPIGEHWGKGTPCNNNSGNPGDCPPLQLINSVIQDGDMVDTGFGCMDFNTLQASKSDVPIDICSSVCKYPDYLQMASEPYGDSLFFFLRREQMFVRHFFNRAGTLGDPVPGDLYIQGSNSGNTATVQSSAFFPTPSGSMVTSESQLFNKPYWLQRAQGHNNGICWGNQLFVTVVDTTRSTNMTLCAEVKKESTYKNENFKEYLRHGEEFDLQFIFQLCKITLTADVMTYIHKMDATILEDWQFGLTPPPSASLEDTYRFVTSTAITCQKNTPPKGKEDPLKDYMFWEVDLKEKFSADLDQFPLGRKFLLQAGLQARPKLKRPASSAPRTSTKKKKVKR

SEQ ID NO: 42 - protein, 499 aa, Human papillomavirus
MATWRPSENKVYLPPTPVSKVVATDSYVKRTSIFYHAGSSRLLAVGHPYYSVTKDNTKTNIPKVSAYQYRVFRVRLPDPNKFGLPDTNIYNPDQERLVWACVGLEVGRGQPLGAGLSGHPLFNRLDDTESSNLANNNVIEDSRDNISVDGKQTQLCIVGCTPAMGEHWTKGAVCKSTQVTTGDCPPLALINTPIEDGDMIDTGFGAMDFKVLQESKAEVPLDIVQSTCKYPDYLKMSADAYGDSMWFYLRREQLFARHYFNRAGKVGETIPAELYLKGSNGREPPPSSVYVATPSGSMITSEAQLFNKPYWLQRAQGHNNGICWGNQLFVTVVDTTRSTNMTISTATEQLSKYDARKINQYLRHVEEYELQFVFQLCKITLSAEVMAYLHNMNANLLEDWNIGLSPPVATSLEDKYRYVRSTAITCQREQPPTEKQDPLAKYKFWDVNLQDSFSTDLDQFPLGRKFLMQLGTRSKPAVATSKKRSAPTSTSTPAKRKRR

SEQ ID NO: 43 - protein, 498 aa, Human papillomavirus
MSVWRPSEATVYLPPVPVSKVVSTDEYVSRTSIYYYAGSSRLLAVGNPYFSIKSPNNNKKVLVPKVSGLQYRVFRVRLPDPNKFGFPDTSFYNPDTQRLVWACVGLEIGRGQPLGVGVSGHPYLNKFDDTETSNRYPAQPGSDNRECLSMDYKQTQLCLIGCKPPTGEHWGKGVACNNNAAATDCPPLELFNSIIEDGDMVDTGFGCMDFGTLQANKSDVPIDICNSTCKYPDYLKMASEPYGDSLFFFLRREQMFVRHFFNRAGKLGEAVPDDLYIKGSGNTAVIQSSAFFPTPSGSIVTSESQLFNKPYWLQRAQGHNNGICWGNQLFVTVVDTTRSTNMTLCTEVTKEGTYKNDNFKEYVRHVEEYDLQFVFQLCKITLTAEIMTYIHTMDSNILEDWQFGLTPPPSASLQDTYRFVTSQAITCQKTAPPKEKEDPLNKYTFWEVNLKEKFSADLDQFPLGRKFLLQSGLKAKPRLKRSAPTTRAPSTKRKKVKK

SEQ ID NO: 44 - protein, 508 aa, Human papillomavirus
MALWRSSDNKVYLPPPSVAKVVSTDEYVTRTSIFYHAGSSRLLTVGHPYFKVPKGGNGRQDVPKVSAYQYRVFRVKLPDPNKFGLPDNTVYDPNSQRLVWACVGVEIGRGQPLGVGLSGHPLYNKLDDTENSHVASAVDTKDTRDNVSVDYKQTQLCIIGCVPAIGEHWTKGTACKPTTVVQGDCPPLELINTPIEDGDMVDTGYGAMDFKLLQDNKSEVPLDICQSICKYPDYLQMSADAYGDSMFFCLRREQVFARHFWNRSGTMGDQLPESLYIKGTDIRANPGSYLYSPSPSGSVVTSDSQLFNKPYWLHKAQGLNNGICWHNQLFLTVVDTTRSTNLSVCASTTSSIPNVYTPTSFKEYARHVEEFDLQFIFQLCKITLTTEVMSYIHNMNTTILEDWNFGVTPPPTASLVDTYRFVQSAAVTCQKDTAPPVKQDPYDKLKFWPVDLKERFSADLDQFPLGRKFLLQLGARPKPTIGPRKRAAPAPTSTPSPKRVKRRKSSRK

SEQ ID NO: 45 - protein, 505 aa, Human papillomavirus
MALWRASDNMVYLPPPSVAKVVNTDDYVTRTGMYYYAGTSRLLTVGHPYFKVPMSGGRKQGIPKVSAYQYRVFRVTLPDPNKFSVPESTLYNPDTQRMVWACVGVEIGRGQPLGVGLSGHPLYNRLDDTENSPFSSNKNPKDSRDNVAVDCKQTQLCIIGCVPAIGEHWAKGKSCKPTNVQQGDCPPLELVNTPIEDGDMIDTGYGAMDFGTLQETKSEVPLDICQSVCKYPDYLQMSADVYGDSMFFCLRREQLFARHFWNRGGMVGDTIPTDMYIKGTDIRETPSSYVYAPSPSGSMVSSDSQLFNKPYWLHKAQGHNNGICWHNQLFLTVVDTTRSTNFTLSTTTDSTVPAVYDSNKFKEYVRHVEEYDLQFIFQLCTITLSTDVMSYIHTMNPAILDDWNFGVAPPPSASLVDTYRYLQSAAITCQKDAPAPVKKDPYDGLNFWNVDLKEKFSSELDQFPLGRKFLLQAGVRRRPTIGPRKRTATAATTSTSKHKRKRVSK

SEQ ID NO: 46 - protein, 503 aa, Human papillomavirus
MWRPTDAKVYLPPVSVSKVVSTDEYVTRTNIYYYAGSTRLLAVGHPYFPIKDSQKRKTIVPKVSGLQYRVFRLRLPDPNKFGFPDASFYNPDKERLVWACSGVEVGRGQPLGIGTSGNPFMNKLDDTENAPKYIAGQNTDGRECMSVDYKQTQLCILGCRPPLGEHWGPGTPCTSQTVNTGDCPPLELKNTPIQDGDMIDVGFGAMDFKALQANKSDVPIDISNTTCKYPDYLGMAADPYGDSMWFYLRREQMFVRHLFNRAGDTGDKIPDDLMIKGTGNTATPSSCVFYPTPSGSMVSSDAQLFNKPYWLQKAQGQNNGICWHNQLFLTVVDTTRSTNFSVCVGTQASSSTTTYANSNFKEYLRHAEEFDLQFVFQLCKISLTTEVMTYIHSMNSTILEEWNFGLTPPPSGTLEETYRYVTSQAISCQRPQPPKETEDPYAKLSFWDVDLKEKFSAELDQFPLGRKFLLQLGMRARPKLQASKRSASATTSATPKKKRAKRI

SEQ ID NO: 47 - protein, 503 aa, Human papillomavirus
MALWRTNDSKVYLPPAPVSRIVNTEEYITRTGIYYYAGSSRLITLGHPYFSIPKTNTRAEIPKVSAFQYRVFRVQLPDPNKFGLPDPNLFNPDTDRLVWGCVGVEVGRGQPLGVGLSGHPLFNKYDDTENSRFANGNDQQDVRDNISVDNKQTQLCIIGCAPPIGEHWATGTTCKNVPVPQGDCPPLELVSTVIEDGDMVDTGFGAMDFANLQATKSDVPLDIAQSVCKYPDYLKMSADTYGNSMFFHLRREQIFARHYYNKAGVVGDAIPDKAYIKGTGAGRDPISSYIYSATPSGSMITSDSQIFNKPYWLHRAQGHNNGICWNNQLFITCVDTTKSTNLTISTAVTPSVAQTFTPANFKQYIRHGEEYELQFIFQLCKITLTTEIMAYLHTMDSTILEQWNFGLTLPPSASLEDAYRFVKNAATSCHKDSPPQAKEDPLAKYKFWNVDLKERFSLDLDQFALGRKFLLQIGAQRKPRPGLKRPAPSSSASSSAKRKRVKK

SEQ ID NO: 48 - protein, 124 aa, Artificial Sequence
  Synthetic Polypeptide
METPAQLLFLLLLWLPDTTGHGPKATLQDIVLHLEPQNEIPVDLLGHGQLSDSEEENDEIDGVNHQHLPARRAEPQRHTMLCMCCKCEARIKLVVESSADDLRAFQQLFLNTLSFVCPWCASQQ

SEQ ID NO: 49 - protein, 105 aa, Artificial Sequence
  Synthetic Polypeptide
MHGPKATLQDIVLHLEPQNEIPVDLLGHGQLSDSEEENDEIDGVNHQHLPARRAEPQRHTMLCMCCKCEARIKLVVESSADDLRAFQQLFLNTLSFVCPWCASQQ

SEQ ID NO: 50 - protein, 117 aa, Artificial Sequence
  Synthetic Polypeptide
METPAQLLFLLLLWLPDTTGHGDTPTLHEYMLDLQPETTDLYGYGQLNDSSEEEDEIDGPAGQAEPDRAHYNIVTFCCKCDSTLRLCVQSTHVDIRTLEDLLMGTLGIVCPICSQKP

SEQ ID NO: 51 - protein, 98 aa, Artificial Sequence
  Synthetic Polypeptide
MHGDTPTLHEYMLDLQPETTDLYGYGQLNDSSEEEDEIDGPAGQAEPDRAHYNIVTFCCKCDSTLRLCVQSTHVDIRTLEDLLMGTLGIVCPICSQKP

SEQ ID NO: 52 - protein, 169 aa, Artificial Sequence
  Synthetic Polypeptide
METPAQLLFLLLLWLPDTTGARFEDPTRSGYKLPDLCTELNTSLQDIEITCVYCKTVLELTEVFEKDLFVVYRDSIPHAACHKCIDFYSRIRELRHYSDSVYGDTLEKLTNTGLYNLLIRCLRCQKPLLRHLNEKRRFHNIAGHYRGQCHSCCNRARQERLQRRRETQV

SEQ ID NO: 53 - protein, 150 aa, Artificial Sequence
  Synthetic Polypeptide
MARFEDPTRSGYKLPDLCTELNTSLQDIEITCVYCKTVLELTEVFEKDLFVVYRDSIPHAACHKCIDFYSRIRELRHYSDSVYGDTLEKLTNTGLYNLLIRCLRCQKPLLRHLNEKRRFHNIAGHYRGQCHSCCNRARQERLQRRRETQV

SEQ ID NO: 54 - protein, 169 aa, Artificial Sequence
  Synthetic Polypeptide
METPAQLLFLLLLWLPDTTGHQKRTAMFQDPQESGRKLPQLCTELQTTIHDIILECVYCKQQLLRREVYDRDLCIVYRDGNPYAVCDKCLKFYSKISEYRHYCYSLYGTTLEQQYNKPLCDLLIRCINCQKPLQRHLDKKQRFHNIRGRWTGRCMSCCRSSRTRRETQL

SEQ ID NO: 55 - protein, 150 aa, Artificial Sequence
  Synthetic Polypeptide
MHQKRTAMFQDPQESGRKLPQLCTELQTTIHDIILECVYCKQQLLRREVYDRDLCIVYRDGNPYAVCDKCLKFYSKISEYRHYCYSLYGTTLEQQYNKPLCDLLIRCINCQKPLQRHLDKKQRFHNIRGRWTGRCMSCCRSSRTRRETQL

SEQ ID NO: 56 - protein, 105 aa, Human papillomavirus
MHGPKATLQDIVLHLEPQNEIPVDLLCHEQLSDSEEENDEIDGVNHQHLPARRAEPQRHTMLCMCCKCEARIELVVESSADDLRAFQQLFLNTLSFVCPWCASQQ

SEQ ID NO: 57 - protein, 98 aa, Human papillomavirus
MHGDTPTLHEYMLDLQPETTDLYCYEQLNDSSEEEDEIDGPAGQAEPDRAHYNIVTFCCKCDSTLRLCVQSTHVDIRTLEDLLMGTLGIVCPICSQKP

SEQ ID NO: 58 - protein, 158 aa, Human papillomavirus
MARFEDPTRRPYKLPDLCTELNTSLQDIEITCVYCKTVLELTEVFEFAFKDLFVVYRDSIPHAACHKCIDFYSRIRELRHYSDSVYGDTLEKLTNTGLYNLLIRCLRCQKPLNPAEKLRHLNEKRRFHNIAGHYRGQCHSCCNRARQERLQRRRETQV

SEQ ID NO: 59 - protein, 158 aa, Human papillomavirus
MHQKRTAMFQDPQERPRKLPQLCTELQTTIHDIILECVYCKQQLLRREVYDFAFRDLCIVYRDGNPYAVCDKCLKFYSKISEYRHYCYSLYGTTLEQQYNKPLCDLLIRCINCQKPLCPEEKQRHLDKKQRFHNIRGRWTGRCMSCCRSSRTRRETQL

SEQ ID NO: 60 - protein, 141 aa, Human papillomavirus
MWLQNLLFLGIVVYSLSAPTRSPITVTRPWKHVEAIKEALNLLDDMPVTLNEEVEVVSNEFSFKKLTCVQTRLKIFEQGLRGNFTKLKGALNMTASYYQTYCPPTPETDCETQVTTYADFIDSLKTFLTDIPFECKKPGQK

SEQ ID NO: 61 - protein, 143 aa, Human papillomavirus
MWLQSLLLLGTVACSISAPARSPSPSTQPWEHVNAIQEARRLLNLSRDTAAEMNETVEVISEMFDLQEPTCLQTRLELYKQGLRGSLTKLKGPLTMMASHYKQHCPPTPETSCATQIITFESFKENLKDFLLVIPFDCWEPVQ

SEQ ID NO: 62 - DNA, 1194 bp, Chlamydia trachomatis
atgaaaaaactcttgaaatcggtattagtatttgccgctttgagttctgcttcctccttgcaagctctgcctgtggggaatcctgctgaaccaagccttatgatcgacggaattctgtgggaaggttttggcggagatccttgcgatccttgcaccacttggtgtgacgctatcagcatgcgtgttggttactacggagactttgttttcgaccgtgttttgaaaactgatgtgaataaagaatttcagatgggagcggcgcctactaccagcgatgtagtaggcttacaaaacgatccaacaacaaacgttgctcgtccaaatcccgcttatggcaaacacatgcaagatgctgaaatgtttacgaacgctgcttacatggcattaaatatctgggatcgttttgatgtattttgtacattgggagcaactaccggttatttaaaaggaaactctgcttccttcaacttagttggattattcggaacaaaaacacaatcttctagctttaatacagcgaagcttattcctaacactgctttgaatgaagctgtggttgagctttatataaacactacctttgcttggagcgtaggtgctcgtgcagctctctgggaatgtgggtgtgcaacgttaggagcttctttccaatatgctcaatctaaacctaaagtagaagagttaaatgttctttgtaatgcatccgaatttactattaataagccgaaaggatatgttggggcggaatttccacttaatattaccgcaggaacagaagctgcgacagggactaaggatgcctctattgactaccatgagtggcaagcaagtttagccctttcttacagattaaatatgttcactccttacattggagttaaatggtctagagtaagttttgatgccgacacgatccgtatcgctcagcctaaattggctgaagcaatcttggatgtcactactctaaacccgaccatcgctggtaaaggaagtgtggtctctgccggaaccgataacgaactggctgatacaatgcaaatcgtttccttgcagttgaacaagatgaaatctagaaaatcttgcggtattgcagtaggaacgactattgtagatgcagacaaatacgcagttacagttgaggctcgcttgatcgatgagagagcagctcacgtaaatgcacaattccggttctaa

SEQ ID NO: 63 - DNA, 1194 bp, Chlamydia trachomatis
atgaaaaaactcttgaaatcggtattagtatttgccgctttgagttctgcttcctccttgcaagctctgcctgtggggaatcctgctgaaccaagccttatgatcgacggaattctgtgggaaggttttggcggagatccttgcgatccttgcaccacttggtgtgacgctatcagcatgcgtgttggttactacggagactttgttttcgaccgtgttttgaaaactgatgtgaataaagaatttcagatgggagcggcgcctactaccagcgatgtagcaggcttacaaaacgatccaacaacaaacgttgctcgtccaaatcccgcttatggcaaacacatgcaagatgctgaaatgtttacgaacgctgcttacatggcattaaatatctgggatcgttttgatgtattttgtacattgggagcaactaccggttatttaaaaggaaactctgcttccttcaacttagttggattattcggaacaaaaacacaatcttctagctttaatacagcgaagcttattcctaacactgctttgaatgaagctgtggttgagctttatataaacactacctttgcttggagcgtaggtgctcgtgcagctctctgggaatgtgggtgtgcaacgttaggagcttctttccaatatgctcaatctaaacctaaagtagaagagttaaatgttctttgtaatgcatccgaatttactattaataagccgaaaggatatgttggggcggaatttccacttaatattaccgcaggaacagaagctgcgacagggactaaggatgcctctattgactaccatgagtggcaagcaagtttagccctttcttacagattaaatatgttcactccttacattggagttaaatggtctagagtaagttttgatgccgacacgatccgtatcgctcagcctaaattggctgaagcaatcttggatgtcactactctaaacccgaccatcgctggtaaaggaagtgtggtctcttccggaaccgataacgaactggctgatacaatgcaaatcgtttccttgcagttgaacaagatgaaatctagaaaatcttgcggtattgcagtaggaacgactattgtagatgcagacaaatacgcagttacagttgaggctcgcttgatcgatgagagagcagctcacgtaaatgcacaattccggttctaa

SEQ ID NO: 64 - DNA, 1194 bp, Chlamydia trachomatis
atgaaaaaactcttgaaatcggtattagtatttgccgctttgagttctgcttcctccttgcaagctctgcctgtggggaatcctgctgaaccaagccttatgatcgacggaattctgtgggaaggttttggcggagatccttgcgatccttgcaccacttggtgtgacgctatcagcatgcgtgttggttactacggagactttgttttcgaccgtgttttgaaaactgatgtgaataaagaatttcagatgggagcggcgcctactaccagcgatgtagtaggcttacaaaacgatccaacaacaaacgttgctcgtccaaatcccgcttatggcaaacacatgcaagatgctgaaatgtttacgaacgctgcttacatggcattaaatatctgggatcgttttgatgtattttgtacattgggagcaactaccggttatttaaaaggaaactctgcttccttcaacttagttggattattcggaacaaaaacacaatcttctagctttaatacagcgaagcttattcctaacactgctttgaatgaagctgtggttgagctttatataaacactacctttgcttggagcgtaggtgctcgtgcagctctctgggaatgtgggtgtgcaacgttaggagcttctttccaatatgctcaatctaaacctaaagtagaagagttaaatgttctttgtaatgcatccgaatttactattaataagccgaaaggatatgttggggcggaatttccacttaatattaccgcaggaacagaagctgcgacagggactaaggatgcctctattgactaccatgagtggcaagcaagtttagccctttcttacagattaaatatgttcactccttacattggagttaaatggtctagagtaagttttgatgccgacacgatccgtatcgctcagcctaaattggctgaagcaatcttggatgtcactactctaaacccgaccatcgctggtaaaggaagtgtggtctcttccggaaccgataacgaactggctgatacaatgcaaatcgtttccttgcagttgaacaagatgaaatctagaaaatcttgcggtattgcagtaggaacgactattgtagatgcagacaaatacgcagttacagttgaggctcgcttgatcgatgagagagcagctcacgtaaatgcacaattccggttctaa

SEQ ID NO: 65 - protein, 397 aa, Chlamydia trachomatis
MKKLLKSVLVFAALSSASSLQALPVGNPAEPSLMIDGILWEGFGGDPCDPCATWCDAISMRVGYYGDFVFDRVLKTDVNKEFQMGAAPTTNDAADLQNDPKTNVARPNPAYGKHMQDAEMFTNAAYMALNIWDRFDVFCTLGATTGYLKGNSASFNLVGLFGTKTKSSDFNTAKLVPNIALNRAVVELYTDTTFAWSVGARAALWECGCATLGASFQYAQSKPKVEELNVLCNASEFTINKPKGYVGAEFPLDITAGTEAATGTKDASIDYHEWQASLALSYRLNMFTPYIGVKWSRVSFDADTIRIAQPKLAEAILDVTTLNPTIAGKGTVVASGSDNDLADTMQIVSLQLNKMKSRKSCGIAVGTTIVDADKYAVTVETRLIDERAAHVNAQFRF

SEQ ID NO: 66 - protein, 395 aa, Chlamydia trachomatis
MKKLLKSVLVFAALSSASSLQALPVGNPAEPSLMIDGILWEGFGGDPCDPCTTWCDAISMRMGYYGDFVFDRVLKTDVNKEFEMGEALAGASGNTTSTLSKLVERTNPAYGKHMQDAEMFTNAACMTLNIWDRFDVFCTLGATSGYLKGNSASFNLVGLFGDGVNATKPAADSIPNVQLNQSVVELYTDTTFAWSVGARAALWECGCATLGASFQYAQSKPKIEELNVLCNAAEFTINKPKGYVGKEFPLDLTAGTDAATGTKDASIDYHEWQASLSLSYRLNMFTPYIGVKWSRASFDSDTIRIAQPRLVTPVVDITTLNPTIAGCGSVAGANTEGQISDTMQIVSLQLNKMKSRKSCGIAVGTTIVDADKYAVTVETRLIDERAAHVNAQFRF

SEQ ID NO: 67 - protein, 393 aa, Chlamydia trachomatis
MKKLLKSVLVFAALSSASSLQALPVGNPAEPSLMIDGILWEGFGGDPCDPCTTWCDAISMRMGYYGDFVFDRVLKTDVNKEFQMGDKPTSTTGNATAPTTLTARENPAYGRHMQDAEMFTNAACMALNIWDRFDVFCTLGASSGYLKGNSASFNLVGLFGDNENQSTVKTNSVPNMSLDQSVVELYTDTAFSWSVGARAALWECGCATLGASFQYAQSKPKVEELNVLCNAAEFTINKPKGYVGQEFPLALIAGTDAATGTKDASIDYHEWQASLALSYRLNMFTPYIGVKWSRASFDADTIRIAQPKSATAIFDTTTLNPTIAGAGDVKASAEGQLGDTMQIVSLQLNKMKSRKSCGIAVGTTIVDADKYAVTVETRLIDERAAHVNAQFRF

SEQ ID NO: 68 - protein, 393 aa, Chlamydia trachomatis
MKKLLKSVLVFAALSSASSLQALPVGNPAEPSLMIDGILWEGFGGDPCDPCATWCDAISMRVGYYGDFVFDRVLKTDVNKEFQMGAKPTTDTGNSAAPSTLTARENPAYGRHMQDAEMFTNAACMALNIWDRFDVFCTLGATSGYLKGNSASFNLVGLFGDNENQKTVKAESVPNMSFDQSVVELYTDTTFAWSVGARAALWECGCATLGASFQYAQSKPKVEELNVLCNAAEFTINKPKGYVGKEFPLDLTAGTDAATGTKDASIDYHEWQASLALSYRLNMFTPYIGVKWSRASFDADTIRIAQPKSATAIFDTTTLNPTIAGAGDVKTGAEGQLGDTMQIVSLQLNKMKSRKSCGIAVGTTIVDADKYAVTVETRLIDERAAHVNAQFRF

SEQ ID NO: 69 - protein, 396 aa, Chlamydia trachomatis
MKKLLKSVLVFAALSSASSLQALPVGNPAEPSLMIDGILWEGFGGDPCDPCTTWCDAISMRMGYYGDFVFDRVLKTDVNKEFQMGAAPTTKDVAGLENDPTTNVARPNPAYGKHMQDAEMFTNAAYMALNIWDRFDVFCTLGATTGYLKGNSASFNLVGLFGTKTQSSNFNTAKLVPNAALNQAVVELYTDTTFAWSVGARAALWECGCATLGASFQYAQSKPKVEELNVLCNASEFTINKPKGYVGAEFPLDIIAGTEAATGTKDASIDYHEWQASLALSYRLNMFTPYIGVKWSRVSFDADTIRIAQPKLAEAILDVTTLNPTIAGKGTVVSSAENELADTMQIVSLQLNKMKSRKSCGIAVGTTIVDADKYAVTVETRLIDERAAHVNAQFRF

SEQ ID NO: 70 - protein, 395 aa, Chlamydia trachomatis
MKKLLKSVLVFAALSSASSLQALPVGNPAEPSLMIDGILWEGFGGDPCDPCTTWCDAISMRMGYYGDFVFDRVLKTDVNKEFEMGEALAGASGNTTSTLSKLVERTNPAYGKHMQDAEMFTNAACMALNIWDRFDVFCTLGATSGYLRGNSASFNLVGLFGDGENATQPAATSIPNVQLNQSVVELYTDTAFAWSVGARAALWECGCATLGASFQYAQSKPKVEELNVLCNAAEFTINKPKGYVGQEFPLALTAGTDAATGTKDASIDYHEWQASLSLSYRLNMFTPYIGVKWSRASFDSNTIRIAQPKLAKPVVDITTLNPTIAGCGSVVAANAEGQISDTMQIVSLQLNKMKSRKSCGIAVGTTIVDADKYAVTVETRLIDERAAHVNAQFRF

SEQ ID NO: 71 - protein, 397 aa, Chlamydia trachomatis
MKKLLKSVLVFAALSSASSLQALPVGNPAEPSLMIDGILWEGFGGDPCDPCTTWCDAISMRMGYYGDFVFDRVLKTDVNKEFQMGAAPTTSDVAGLQNDPTTNVARPNPAYGKHMQDAEMFTNAAYMALNIWDRFDVFCTLGATTGYLKGNSASFNLVGLFGTKTQASSFNTANLFPNTALNQAVVELYTDTTFAWSVGARAALWECGCATLGASFQYAQSKPKVEELNVLCNASEFTINKPKGYVGAEFPLDITAGTEAATGTKDASIDYHEWQASLALSYRLNMFTPYIGVKWSRVSFDADTIRIAQPKLAEAILDVTTLNPTIAGKGTVVASGSENDLADTMQIVSLQLNKMKSRKSCGIAVGTTIVDADKYAVTVETRLIDERAAHVNAQFRF

SEQ ID NO: 72 - protein, 396 aa, Chlamydia trachomatis
MKKLLKSVLVFAALSSASSLQALPVGNPAEPSLMIDGILWEGFGGDPCDPCTTWCDAISMRVGYYGDFVFDRVLKTDVNKEFQMGAAPTTSDVEGLQNDPTTNVARPNPAYGKHMQDAEMFTNAAYMALNIWDRFDVFCTLGATTGYLRGNSASFNLVGLFGTKTQYSKFNTANLVPNTALDRAVVELYTDTTFAWSVGARAALWECGCATLGASFQYAQSKPKVEELNVLCNASEFTINKPKGYVGVEFPLDITGTEAATGTKDASIDYHEWQASLALSYRLNMFTPYIGVKWSRVSFDADTIRIAQPKLAEAILDVTTLNPTIAGKGAVVSSGSDNELADTMQIVSLQLNKLKSRKSCGIAVGTTIVDADKYAVTVETRLIDERAAHVNAQFRF

SEQ ID NO: 73 - protein, 133 aa, Artificial Sequence
  Synthetic Polypeptide
METPAQLLFLLLLWLPDTTGPPLPSSTQDNRSMDQQDSEEFLLQNTLEDSEIISIPDTMNQIAIDTEKWFYLNKDCTNVGPISIVQLTAFLKECKHSPEKGIDPQELWVWKKGMPNWEKVKNIPELSGTVKDE

SEQ ID NO: 74 - protein, 139 aa, Artificial Sequence
  Synthetic Polypeptide
METPAQLLFLLLLWLPDTTGPPLPSSTQDNRSMDQQDSEEFLLQNTLEDSEIISIPDTMNQIAIDTEKWFYLNKDCTNVGPISIVQLTAFLKECKHSPEKGIDPQELWVWKKGMPNWEKVKNIPELSGTVKDEHHHHHH

SEQ ID NO: 75 - protein, 1061 aa, Artificial Sequence
  Synthetic Polypeptide
METPAQLLFLLLLWLPDTTGEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKMSIRGVGGNGNSRIPSHNGDGSNRRSQNTKGNNKVEDRVCSLYSSRSNENRESPYAVVDVSSMIESTPTSGETTRASRGVLSRFQRGLVRIADKVRRAVQCAWSSVSTSRSSATRAAESGSSSRTARGASSGYREYSPSAARGLRLMFTDFWRTRVLRQTSPMAGVFGNLDVNEARLMAAYTSECADHLEAKELAGPDGVAAAREIAKRWEKRVRDLQDKGAARKLLNDPLGRRTPNYQSKNPGEYTVGNSMFYDGPQVANLQNVDTGFWLDMQHLSDVVLSREIQTGLRARATLEESMPMLENLEERFRRLQETCDAARTEIEESGWTRESASRMEGDEAQGPSRVQQAFQSFVNECNSIEFSFGSFGEHVRVLCARVSRGLAAAGEAIRRCFSCCKGSTHRYAPRDDLSPEGASLAETLARFADDMGIERGADGTYDIPLVDDWRRGVPSIEGEGSDSIYEIMMPIYEVMNMDLETRRSFAVQQGHYQDPRASDYDLPRASDYDLPRSPYPTPPLPPRYQLQNMDVEAGFREAVYASFVAGMYNYVVTQPQERIPNSQQVEGILRDMLTNGDQTFRDLMKRWNREVDREMSPILGYWKIKGLVQPTRLLLEYLEEKYEEHLYERDEGDKWRNKKFELGLEFPNLPYYIDGDVKLTQSMAIIRYIADKHNMLGGCPKERAEISMLEGAVLDIRYGVSRIAYSKDFETLKVDFLSKLPEMLKMFEDRLCHKTYLNGDHVTHPDFMLYDALDVVLYMDPMCLDAFPKLVCFKKRIEAIPQIDKYLKSSKYIAWPLQGWQATFGGGDHPPK

SEQ ID NO: 76 - protein, 849 aa, Artificial Sequence
  Synthetic Polypeptide
METPAQLLFLLLLWLPDTTGEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKMSIRGVGGNGNSRIPSHNGDGSNRRSQNTKGNNKVEDRVCSLYSSRSNENRESPYAVVDVSSMIESTPTSGETTRASRGVLSRFQRGLVRIADKVRRAVQCAWSSVSTSRSSATRAAESGSSSRTARGASSGYREYSPSAARGLRLMFTDFWRTRVLRQTSPMAGVFGNLDVNEARLMAAYTSECADHLEAKELAGPDGVAAAREIAKRWEKRVRDLQDKGAARKLLNDPLGRRTPNYQSKNPGEYTVGNSMFYDGPQVANLQNVDTGFWLDMSNLSDVVLSREIQTGLRARATLEESMPMLENLEERFRRLQETCDAARTEIEESGWTRESASRMEGDEAQGPSRVQQAFQSFVNECNSIEFSFGSFGEHVRVLCARVSRGLAAAGEAIRRCFSCCKGSTHRYAPRDDLSPEGASLAETLARFADDMGIERGADGTYDIPLVDDWRRGVPSIEGEGSDSIYEIMMPIYEVMNMDLETRRSFAVQQGHYQDPRASDYDLPRASDYDLPRSPYPTPPLPPRYQLQNMDVEAGFREAVYASFVAGMYNYVVTQPQERIPNSQQVEGILRDMLTNGSQTFRDLMKRWNREVDREHHHHHH

SEQ ID NO: 77 - protein, 843 aa, Artificial Sequence
  Synthetic Polypeptide
METPAQLLFLLLLWLPDTTGEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKMSIRGVGGNGNSRIPSHNGDGSNRRSQNTKGNNKVEDRVCSLYSSRSNENRESPYAVVDVSSMIESTPTSGETTRASRGVLSRFQRGLVRIADKVRRAVQCAWSSVSTSRSSATRAAESGSSSRTARGASSGYREYSPSAARGLRLMFTDFWRTRVLRQTSPMAGVFGNLDVNEARLMAAYTSECADHLEAKELAGPDGVAAAREIAKRWEKRVRDLQDKGAARKLLNDPLGRRTPNYQSKNPGEYTVGNSMFYDGPQVANLQNVDTGFWLDMQHLSDVVLSREIQTGLRARATLEESMPMLENLEERFRRLQETCDAARTEIEESGWTRESASRMEGDEAQGPSRVQQAFQSFVNECNSIEFSFGSFGEHVRVLCARVSRGLAAAGEAIRRCFSCCKGSTHRYAPRDDLSPEGASLAETLARFADDMGIERGADGTYDIPLVDDWRRGVPSIEGEGSDSIYEIMMPIYEVMNMDLETRRSFAVQQGHYQDPRASDYDLPRASDYDLPRSPYPTPPLPPRYQLQNMDVEAGFREAVYASFVAGMYNYVVTQPQERIPNSQQVEGILRDMLTNGDQTFRDLMKRWNREVDRE

SEQ ID NO: 78 - protein, 843 aa, Artificial Sequence
  Synthetic Polypeptide
METPAQLLFLLLLWLPDTTGEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKMSIRGVGGNGNSRIPSHNGDGSNRRSQNTKGNNKVEDRVCSLYSSRSNENRESPYAVVDVSSMIESTPTSGETTRASRGVLSRFQRGLVRIADKVRRAVQCAWSSVSTSRSSATRAAESGSSSRTARGASSGYREYSPSAARGLRLMFTDFWRTRVLRQTSPMAGVFGNLDVNEARLMAAYTSECADHLEAKELAGPDGVAAAREIAKRWEKRVRDLQDKGAARKLLNDPLGRRTPNYQSKNPGEYTVGNSMFYDGPQVANLQNVDTGFWLDMSNLSDVVLSREIQTGLRARATLEESMPMLENLEERFRRLQETCDAARTEIEESGWTRESASRMEGDEAQGPSRVQQAFQSFVNECNSIEFSFGSFGEHVRVLCARVSRGLAAAGEAIRRCFSCCKGSTHRYAPRDDLSPEGASLAETLARFADDMGIERGADGTYDIPLVDDWRRGVPSIEGEGSDSIYEIMMPIYEVMNMDLETRRSFAVQQGHYQDPRASDYDLPRASDYDLPRSPYPTPPLPPRYQLQNMDVEAGFREAVYASFVAGMYNYVVTQPQERIPNSQQVEGILRDMLTNGSQTFRDLMKRWNREVDRE

SEQ ID NO: 79 - protein, 835 aa, Artificial Sequence
  Synthetic Polypeptide
METPAQLLFLLLLWLPDTTGMSPILGYWKIKGLVQPTRLLLEYLEEKYEEHLYERDEGDKWRNKKFELGLEFPNLPYYIDGDVKLTQSMAIIRYIADKHNMLGGCPKERAEISMLEGAVLDIRYGVSRIAYSKDFETLKVDFLSKLPEMLKMFEDRLCHKTYLNGDHVTHPDFMLYDALDVVLYMDPMCLDAFPKLVCFKKRIEAIPQIDKYLKSSKYIAWPLQGWQATFGGGDHPPKMSIRGVGGNGNSRIPSHNGDGSNRRSQNTKGNNKVEDRVCSLYSSRSNENRESPYAVVDVSSMIESTPTSGETTRASRGVLSRFQRGLVRIADKVRRAVQCAWSSVSTSRSSATRAAESGSSSRTARGASSGYREYSPSAARGLRLMFTDFWRTRVLRQTSPMAGVFGNLDVNEARLMAAYTSECADHLEAKELAGPDGVAAAREIAKRWEKRVRDLQDKGAARKLLNDPLGRRTPNYQSKNPGEYTVGNSMFYDGPQVANLQNVDTGFWLDMQHLSDVVLSREIQTGLRARATLEESMPMLENLEERFRRLQETCDAARTEIEESGWTRESASRMEGDEAQGPSRVQQAFQSFVNECNSIEFSFGSFGEHVRVLCARVSRGLAAAGEAIRRCFSCCKGSTHRYAPRDDLSPEGASLAETLARFADDMGIERGADGTYDIPLVDDWRRGVPSIEGEGSDSIYEIMMPIYEVMNMDLETRRSFAVQQGHYQDPRASDYDLPRASDYDLPRSPYPTPPLPPRYQLQNMDVEAGFREAVYASFVAGMYNYVVTQPQERIPNSQQVEGILRDMLTNGDQTFRDLMKRWNREVDREHHHHHH

SEQ ID NO: 80 - protein, 835 aa, Artificial Sequence
  Synthetic Polypeptide
METPAQLLFLLLLWLPDTTGMSPILGYWKIKGLVQPTRLLLEYLEEKYEEHLYERDEGDKWRNKKFELGLEFPNLPYYIDGDVKLTQSMAIIRYIADKHNMLGGCPKERAEISMLEGAVLDIRYGVSRIAYSKDFETLKVDFLSKLPEMLKMFEDRLCHKTYLNGDHVTHPDFMLYDALDVVLYMDPMCLDAFPKLVCFKKRIEAIPQIDKYLKSSKYIAWPLQGWQATFGGGDHPPKMSIRGVGGNGNSRIPSHNGDGSNRRSQNTKGNNKVEDRVCSLYSSRSNENRESPYAVVDVSSMIESTPTSGETTRASRGVLSRFQRGLVRIADKVRRAVQCAWSSVSTSRSSATRAAESGSSSRTARGASSGYREYSPSAARGLRLMFTDFWRTRVLRQTSPMAGVFGNLDVNEARLMAAYTSECADHLEAKELAGPDGVAAAREIAKRWEKRVRDLQDKGAARKLLNDPLGRRTPNYQSKNPGEYTVGNSMFYDGPQVANLQNVDTGFWLDMSNLSDVVLSREIQTGLRARATLEESMPMLENLEERFRRLQETCDAARTEIEESGWTRESASRMEGDEAQGPSRVQQAFQSFVNECNSIEFSFGSFGEHVRVLCARVSRGLAAAGEAIRRCFSCCKGSTHRYAPRDDLSPEGASLAETLARFADDMGIERGADGTYDIPLVDDWRRGVPSIEGEGSDSIYEIMMPIYEVMNMDLETRRSFAVQQGHYQDPRASDYDLPRASDYDLPRSPYPTPPLPPRYQLQNMDVEAGFREAVYASFVAGMYNYVVTQPQERIPNSQQVEGILRDMLTNGSQTFRDLMKRWNREVDREHHHHHH

SEQ ID NO: 81 - protein, 829 aa, Artificial Sequence
  Synthetic Polypeptide
METPAQLLFLLLLWLPDTTGMSPILGYWKIKGLVQPTRLLLEYLEEKYEEHLYERDEGDKWRNKKFELGLEFPNLPYYIDGDVKLTQSMAIIRYIADKHNMLGGCPKERAEISMLEGAVLDIRYGVSRIAYSKDFETLKVDFLSKLPEMLKMFEDRLCHKTYLNGDHVTHPDFMLYDALDVVLYMDPMCLDAFPKLVCFKKRIEAIPQIDKYLKSSKYIAWPLQGWQATFGGGDHPPKMSIRGVGGNGNSRIPSHNGDGSNRRSQNTKGNNKVEDRVCSLYSSRSNENRESPYAVVDVSSMIESTPTSGETTRASRGVLSRFQRGLVRIADKVRRAVQCAWSSVSTSRSSATRAAESGSSSRTARGASSGYREYSPSAARGLRLMFTDFWRTRVLRQTSPMAGVFGNLDVNEARLMAAYTSECADHLEAKELAGPDGVAAAREIAKRWEKRVRDLQDKGAARKLLNDPLGRRTPNYQSKNPGEYTVGNSMFYDGPQVANLQNVDTGFWLDMQHLSDVVLSREIQTGLRARATLEESMPMLENLEERFRRLQETCDAARTEIEESGWTRESASRMEGDEAQGPSRVQQAFQSFVNECNSIEFSFGSFGEHVRVLCARVSRGLAAAGEAIRRCFSCCKGSTHRYAPRDDLSPEGASLAETLARFADDMGIERGADGTYDIPLVDDWRRGVPSIEGEGSDSIYEIMMPIYEVMNMDLETRRSFAVQQGHYQDPRASDYDLPRASDYDLPRSPYPTPPLPPRYQLQNMDVEAGFREAVYASFVAGMYNYVVTQPQERIPNSQQVEGILRDMLTNGDQTFRDLMKRWNREVDRE

SEQ ID NO: 82 - protein, 829 aa, Artificial Sequence
  Synthetic Polypeptide
METPAQLLFLLLLWLPDTTGMSPILGYWKIKGLVQPTRLLLEYLEEKYEEHLYERDEGDKWRNKKFELGLEFPNLPYYIDGDVKLTQSMAIIRYIADKHNMLGGCPKERAEISMLEGAVLDIRYGVSRIAYSKDFETLKVDFLSKLPEMLKMFEDRLCHKTYLNGDHVTHPDFMLYDALDVVLYMDPMCLDAFPKLVCFKKRIEAIPQIDKYLKSSKYIAWPLQGWQATFGGGDHPPKMSIRGVGGNGNSRIPSHNGDGSNRRSQNTKGNNKVEDRVCSLYSSRSNENRESPYAVVDVSSMIESTPTSGETTRASRGVLSRFQRGLVRIADKVRRAVQCAWSSVSTSRSSATRAAESGSSSRTARGASSGYREYSPSAARGLRLMFTDFWRTRVLRQTSPMAGVFGNLDVNEARLMAAYTSECADHLEAKELAGPDGVAAAREIAKRWEKRVRDLQDKGAARKLLNDPLGRRTPNYQSKNPGEYTVGNSMFYDGPQVANLQNVDTGFWLDMSNLSDVVLSREIQTGLRARATLEESMPMLENLEERFRRLQETCDAARTEIEESGWTRESASRMEGDEAQGPSRVQQAFQSFVNECNSIEFSFGSFGEHVRVLCARVSRGLAAAGEAIRRCFSCCKGSTHRYAPRDDLSPEGASLAETLARFADDMGIERGADGTYDIPLVDDWRRGVPSIEGEGSDSIYEIMMPIYEVMNMDLETRRSFAVQQGHYQDPRASDYDLPRASDYDLPRSPYPTPPLPPRYQLQNMDVEAGFREAVYASFVAGMYNYVVTQPQERIPNSQQVEGILRDMLTNGSQTFRDLMKRWNREVDRE

SEQ ID NO: 83 - protein, 600 aa, Artificial Sequence
  Synthetic Polypeptide
METPAQLLFLLLLWLPDTTGMSIRGVGGNGNSRIPSHNGDGSNRRSQNTKGNNKVEDRVCSLYSSRSNENRESPYAVVDVSSMIESTPTSGETTRASRGVLSRFQRGLVRIADKVRRAVQCAWSSVSTSRSSATRAAESGSSSRTARGASSGYREYSPSAARGLRLMFTDFWRTRVLRQTSPMAGVFGNLDVNEARLMAAYTSECADHLEAKELAGPDGVAAAREIAKRWEKRVRDLQDKGAARKLLNDPLGRRTPNYQSKNPGEYTVGNSMFYDGPQVANLQNVDTGFWLDMQHLSDVVLSREIQTGLRARATLEESMPMLENLEERFRRLQETCDAARTEIEESGWTRESASRMEGDEAQGPSRVQQAFQSFVNECNSIEFSFGSFGEHVRVLCARVSRGLAAAGEAIRRCFSCCKGSTHRYAPRDDLSPEGASLAETLARFADDMGIERGADGTYDIPLVDDWRRGVPSIEGEGSDSIYEIMMPIYEVMNMDLETRRSFAVQQGHYQDPRASDYDLPRASDYDLPRSPYPTPPLPPRYQLQNMDVEAGFREAVYASFVAGMYNYVVTQPQERIPNSQQVEGILRDMLTNGDHHHHHH

SEQ ID NO: 84 - protein, 484 aa, Artificial Sequence
  Synthetic Polypeptide
METPAQLLFLLLLWLPDTTGMSIRGVGGNGNSRIPSHNGDGSNRRSQNTKGNNKVEDRVCSLYSSRSNENRESPYAVVDVSSMIESTPTSGETTRASRGVLSRFQRGLVRIADKVRRAVQCAWSSVSTSRSSATRAAESGSSSRTARGASSGYREYSPSAARGLRLMFTDFWRTRVLRQTSPMAGVFGNLDVNEARLMAAYTSECADHLEAKELAGPDGVAAAREIAKRWEKRVRDLQDKGAARKLLNDPLGRRTPNYQSKNPGEYTVGNSMFYDGPQVANLQNVDTGFWLDMQHLSDVVLSREIQTGLRARATLEESMPMLENLEERFRRLQETCDAARTEIEESGWTRESASRMEGDEAQGPSRVQQAFQSFVNECNSIEFSFGSFGEHVRVLCARVSRGLAAAGEAIRRCFSCCKGSTHRYAPRDDLSPEGASLAETLARFADDMGIERGADGTYDIPLVDDWRRGVPSIEGEGSHHHHHH

SEQ ID NO: 85 - protein, 600 aa, Artificial Sequence
  Synthetic Polypeptide
METPAQLLFLLLLWLPDTTGMSIRGVGGNGNSRIPSHNGDGSNRRSQNTKGNNKVEDRVCSLYSSRSNENRESPYAVVDVSSMIESTPTSGETTRASRGVLSRFQRGLVRIADKVRRAVQCAWSSVSTSRSSATRAAESGSSSRTARGASSGYREYSPSAARGLRLMFTDFWRTRVLRQTSPMAGVFGNLDVNEARLMAAYTSECADHLEAKELAGPDGVAAAREIAKRWEKRVRDLQDKGAARKLLNDPLGRRTPNYQSKNPGEYTVGNSMFYDGPQVANLQNVDTGFWLDMSNLSDVVLSREIQTGLRARATLEESMPMLENLEERFRRLQETCDAARTEIEESGWTRESASRMEGDEAQGPSRVQQAFQSFVNECNSIEFSFGSFGEHVRVLCARVSRGLAAAGEAIRRCFSCCKGSTHRYAPRDDLSPEGASLAETLARFADDMGIERGADGTYDIPLVDDWRRGVPSIEGEGSDSIYEIMMPIYEVMNMDLETRRSFAVQQGHYQDPRASDYDLPRASDYDLPRSPYPTPPLPPRYQLQNMDVEAGFREAVYASFVAGMYNYVVTQPQERIPNSQQVEGILRDMLTNGSHHHHHH

SEQ ID NO: 86 - protein, 484 aa, Artificial Sequence
  Synthetic Polypeptide
METPAQLLFLLLLWLPDTTGMSIRGVGGNGNSRIPSHNGDGSNRRSQNTKGNNKVEDRVCSLYSSRSNENRESPYAVVDVSSMIESTPTSGETTRASRGVLSRFQRGLVRIADKVRRAVQCAWSSVSTSRSSATRAAESGSSSRTARGASSGYREYSPSAARGLRLMFTDFWRTRVLRQTSPMAGVFGNLDVNEARLMAAYTSECADHLEAKELAGPDGVAAAREIAKRWEKRVRDLQDKGAARKLLNDPLGRRTPNYQSKNPGEYTVGNSMFYDGPQVANLQNVDTGFWLDMSNLSDVVLSREIQTGLRARATLEESMPMLENLEERFRRLQETCDAARTEIEESGWTRESASRMEGDEAQGPSRVQQAFQSFVNECNSIEFSFGSFGEHVRVLCARVSRGLAAAGEAIRRCFSCCKGSTHRYAPRDDLSPEGASLAETLARFADDMGIERGADGTYDIPLVDDWRRGVPSIEGEGSHHHHHH

SEQ ID NO: 87 - protein, 594 aa, Artificial Sequence
  Synthetic Polypeptide
METPAQLLFLLLLWLPDTTGMSIRGVGGNGNSRIPSHNGDGSNRRSQNTKGNNKVEDRVCSLYSSRSNENRESPYAVVDVSSMIESTPTSGETTRASRGVLSRFQRGLVRIADKVRRAVQCAWSSVSTSRSSATRAAESGSSSRTARGASSGYREYSPSAARGLRLMFTDFWRTRVLRQTSPMAGVFGNLDVNEARLMAAYTSECADHLEAKELAGPDGVAAAREIAKRWEKRVRDLQDKGAARKLLNDPLGRRTPNYQSKNPGEYTVGNSMFYDGPQVANLQNVDTGFWLDMQHLSDVVLSREIQTGLRARATLEESMPMLENLEERFRRLQETCDAARTEIEESGWTRESASRMEGDEAQGPSRVQQAFQSFVNECNSIEFSFGSFGEHVRVLCARVSRGLAAAGEAIRRCFSCCKGSTHRYAPRDDLSPEGASLAETLARFADDMGIERGADGTYDIPLVDDWRRGVPSIEGEGSDSIYEIMMPIYEVMNMDLETRRSFAVQQGHYQDPRASDYDLPRASDYDLPRSPYPTPPLPPRYQLQNMDVEAGFREAVYASFVAGMYNYVVTQPQERIPNSQQVEGILRDMLTNGD

SEQ ID NO: 88 - protein, 478 aa, Artificial Sequence
  Synthetic Polypeptide
METPAQLLFLLLLWLPDTTGMSIRGVGGNGNSRIPSHNGDGSNRRSQNTKGNNKVEDRVCSLYSSRSNENRESPYAVVDVSSMIESTPTSGETTRASRGVLSRFQRGLVRIADKVRRAVQCAWSSVSTSRSSATRAAESGSSSRTARGASSGYREYSPSAARGLRLMFTDFWRTRVLRQTSPMAGVFGNLDVNEARLMAAYTSECADHLEAKELAGPDGVAAAREIAKRWEKRVRDLQDKGAARKLLNDPLGRRTPNYQSKNPGEYTVGNSMFYDGPQVANLQNVDTGFWLDMQHLSDVVLSREIQTGLRARATLEESMPMLENLEERFRRLQETCDAARTEIEESGWTRESASRMEGDEAQGPSRVQQAFQSFVNECNSIEFSFGSFGEHVRVLCARVSRGLAAAGEAIRRCFSCCKGSTHRYAPRDDLSPEGASLAETLARFADDMGIERGADGTYDIPLVDDWRRGVPSIEGEGS

SEQ ID NO: 89 - protein, 594 aa, Artificial Sequence
  Synthetic Polypeptide
METPAQLLFLLLLWLPDTTGMSIRGVGGNGNSRIPSHNGDGSNRRSQNTKGNNKVEDRVCSLYSSRSNENRESPYAVVDVSSMIESTPTSGETTRASRGVLSRFQRGLVRIADKVRRAVQCAWSSVSTSRSSATRAAESGSSSRTARGASSGYREYSPSAARGLRLMFTDFWRTRVLRQTSPMAGVFGNLDVNEARLMAAYTSECADHLEAKELAGPDGVAAAREIAKRWEKRVRDLQDKGAARKLLNDPLGRRTPNYQSKNPGEYTVGNSMFYDGPQVANLQNVDTGFWLDMSNLSDVVLSREIQTGLRARATLEESMPMLENLEERFRRLQETCDAARTEIEESGWTRESASRMEGDEAQGPSRVQQAFQSFVNECNSIEFSFGSFGEHVRVLCARVSRGLAAAGEAIRRCFSCCKGSTHRYAPRDDLSPEGASLAETLARFADDMGIERGADGTYDIPLVDDWRRGVPSIEGEGSDSIYEIMMPIYEVMNMDLETRRSFAVQQGHYQDPRASDYDLPRASDYDLPRSPYPTPPLPPRYQLQNMDVEAGFREAVYASFVAGMYNYVVTQPQERIPNSQQVEGILRDMLTNGS

SEQ ID NO: 90 - protein, 478 aa, Artificial Sequence
  Synthetic Polypeptide
METPAQLLFLLLLWLPDTTGMSIRGVGGNGNSRIPSHNGDGSNRRSQNTKGNNKVEDRVCSLYSSRSNENRESPYAVVDVSSMIESTPTSGETTRASRGVLSRFQRGLVRIADKVRRAVQCAWSSVSTSRSSATRAAESGSSSRTARGASSGYREYSPSAARGLRLMFTDFWRTRVLRQTSPMAGVFGNLDVNEARLMAAYTSECADHLEAKELAGPDGVAAAREIAKRWEKRVRDLQDKGAARKLLNDPLGRRTPNYQSKNPGEYTVGNSMFYDGPQVANLQNVDTGFWLDMSNLSDVVLSREIQTGLRARATLEESMPMLENLEERFRRLQETCDAARTEIEESGWTRESASRMEGDEAQGPSRVQQAFQSFVNECNSIEFSFGSFGEHVRVLCARVSRGLAAAGEAIRRCFSCCKGSTHRYAPRDDLSPEGASLAETLARFADDMGIERGADGTYDIPLVDDWRRGVPSIEGEGS

SEQ ID NO: 91 - protein, 600 aa, Artificial Sequence; identical to SEQ ID NO: 83
  Synthetic Polypeptide

SEQ ID NO: 92 - protein, 843 aa, Artificial Sequence; identical to SEQ ID NO: 77
  Synthetic Polypeptide

SEQ ID NO: 93 - protein, 849 aa, Artificial Sequence
  Synthetic Polypeptide
METPAQLLFLLLLWLPDTTGEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKMSIRGVGGNGNSRIPSHNGDGSNRRSQNTKGNNKVEDRVCSLYSSRSNENRESPYAVVDVSSMIESTPTSGETTRASRGVLSRFQRGLVRIADKVRRAVQCAWSSVSTSRSSATRAAESGSSSRTARGASSGYREYSPSAARGLRLMFTDFWRTRVLRQTSPMAGVFGNLDVNEARLMAAYTSECADHLEAKELAGPDGVAAAREIAKRWEKRVRDLQDKGAARKLLNDPLGRRTPNYQSKNPGEYTVGNSMFYDGPQVANLQNVDTGFWLDMQHLSDVVLSREIQTGLRARATLEESMPMLENLEERFRRLQETCDAARTEIEESGWTRESASRMEGDEAQGPSRVQQAFQSFVNECNSIEFSFGSFGEHVRVLCARVSRGLAAAGEAIRRCFSCCKGSTHRYAPRDDLSPEGASLAETLARFADDMGIERGADGTYDIPLVDDWRRGVPSIEGEGSDSIYEIMMPIYEVMNMDLETRRSFAVQQGHYQDPRASDYDLPRASDYDLPRSPYPTPPLPPRYQLQNMDVEAGFREAVYASFVAGMYNYVVTQPQERIPNSQQVEGILRDMLTNGDQTFRDLMKRWNREVDREHHHHHH

SEQ ID NO: 94 - protein, 812 aa, Artificial Sequence
  Synthetic Polypeptide
METPAQLLFLLLLWLPDTTGMSPILGYWKIKGLVQPTRLLLEYLEEKYEEHLYERDEGDKWRNKKFELGLEFPNLPYYIDGDVKLTQSMAIIRYIADKHNMLGGCPKERAEISMLEGAVLDIRYGVSRIAYSKDFETLKVDFLSKLPEMLKMFEDRLCHKTYLNGDHVTHPDFMLYDALDVVLYMDPMCLDAFPKLVCFKKRIEAIPQIDKYLKSSKYIAWPLQGWQATFGGGDHPPKMSIRGVGGNGNSRIPSHNGDGSNRRSQNTKGNNKVEDRVCSLYSSRSNENRESPYAVVDVSSMIESTPTSGETTRASRGVLSRFQRGLVRIADKVRRAVQCAWSSVSTSRSSATRAAESGSSSRTARGASSGYREYSPSAARGLRLMFTDFWRTRVLRQTSPMAGVFGNLDVNEARLMAAYTSECADHLEAKELAGPDGVAAAREIAKRWEKRVRDLQDKGAARKLLNDPLGRRTPNYQSKNPGEYTVGNSMFYDGPQVANLQNVDTGFWLDMQHLSDVVLSREIQTGLRARATLEESMPMLENLEERFRRLQETCDAARTEIEESGWTRESASRMEGDEAQGPSRVQQAFQSFVNECNSIEFSFGSFGEHVRVLCARVSRGLAAAGEAIRRCFSCCKGSTHRYAPRDDLSPEGASLAETLARFADDMGIERGADGTYDIPLVDDWRRGVPSIEGEGSDSIYEIMMPIYEVMNMDLETRRSFAVQQGHYQDPRASDYDLPRASDYDLPRSPYPTPPLPPRYQLQNMDVEAGFREAVYASFVAGMYNYVVTQPQERIPNSQQVEGILRDMLTNGD

SEQ ID NO: 95 - protein, 818 aa, Artificial Sequence
  Synthetic Polypeptide
METPAQLLFLLLLWLPDTTGMSPILGYWKIKGLVQPTRLLLEYLEEKYEEHLYERDEGDKWRNKKFELGLEFPNLPYYIDGDVKLTQSMAIIRYIADKHNMLGGCPKERAEISMLEGAVLDIRYGVSRIAYSKDFETLKVDFLSKLPEMLKMFEDRLCHKTYLNGDHVTHPDFMLYDALDVVLYMDPMCLDAFPKLVCFKKRIEAIPQIDKYLKSSKYIAWPLQGWQATFGGGDHPPKMSIRGVGGNGNSRIPSHNGDGSNRRSQNTKGNNKVEDRVCSLYSSRSNENRESPYAVVDVSSMIESTPTSGETTRASRGVLSRFQRGLVRIADKVRRAVQCAWSSVSTSRSSATRAAESGSSSRTARGASSGYREYSPSAARGLRLMFTDFWRTRVLRQTSPMAGVFGNLDVNEARLMAAYTSECADHLEAKELAGPDGVAAAREIAKRWEKRVRDLQDKGAARKLLNDPLGRRTPNYQSKNPGEYTVGNSMFYDGPQVANLQNVDTGFWLDMQHLSDVVLSREIQTGLRARATLEESMPMLENLEERFRRLQETCDAARTEIEESGWTRESASRMEGDEAQGPSRVQQAFQSFVNECNSIEFSFGSFGEHVRVLCARVSRGLAAAGEAIRRCFSCCKGSTHRYAPRDDLSPEGASLAETLARFADDMGIERGADGTYDIPLVDDWRRGVPSIEGEGSDSIYEIMMPIYEVMNMDLETRRSFAVQQGHYQDPRASDYDLPRASDYDLPRSPYPTPPLPPRYQLQNMDVEAGFREAVYASFVAGMYNYVVTQPQERIPNSQQVEGILRDMLTNGDHHHHHH

SEQ ID NO: 96 - protein, 829 aa, Artificial Sequence; identical to SEQ ID NO: 81
  Synthetic Polypeptide

SEQ ID NO: 97 - protein, 835 aa, Artificial Sequence; identical to SEQ ID NO: 79
  Synthetic Polypeptide

SEQ ID NO: 98 - protein, 696 aa, Artificial Sequence
  Synthetic Polypeptide
METPAQLLFLLLLWLPDTTGMSPILGYWKIKGLVQPTRLLLEYLEEKYEEHLYERDEGDKWRNKKFELGLEFPNLPYYIDGDVKLTQSMAIIRYIADKHNMLGGCPKERAEISMLEGAVLDIRYGVSRIAYSKDFETLKVDFLSKLPEMLKMFEDRLCHKTYLNGDHVTHPDFMLYDALDVVLYMDPMCLDAFPKLVCFKKRIEAIPQIDKYLKSSKYIAWPLQGWQATFGGGDHPPKMSIRGVGGNGNSRIPSHNGDGSNRRSQNTKGNNKVEDRVCSLYSSRSNENRESPYAVVDVSSMIESTPTSGETTRASRGVLSRFQRGLVRIADKVRRAVQCAWSSVSTSRSSATRAAESGSSSRTARGASSGYREYSPSAARGLRLMFTDFWRTRVLRQTSPMAGVFGNLDVNEARLMAAYTSECADHLEAKELAGPDGVAAAREIAKRWEKRVRDLQDKGAARKLLNDPLGRRTPNYQSKNPGEYTVGNSMFYDGPQVANLQNVDTGFWLDMQHLSDVVLSREIQTGLRARATLEESMPMLENLEERFRRLQETCDAARTEIEESGWTRESASRMEGDEAQGPSRVQQAFQSFVNECNSIEFSFGSFGEHVRVLCARVSRGLAAAGEAIRRCFSCCKGSTHRYAPRDDLSPEGASLAETLARFADDMGIERGADGTYDIPLVDDWRRGVPSIEGEGS

SEQ ID NO: 99 - protein, 702 aa, Artificial Sequence
  Synthetic Polypeptide
METPAQLLFLLLLWLPDTTGMSPILGYWKIKGLVQPTRLLLEYLEEKYEEHLYERDEGDKWRNKKFELGLEFPNLPYYIDGDVKLTQSMAIIRYIADKHNMLGGCPKERAEISMLEGAVLDIRYGVSRIAYSKDFETLKVDFLSKLPEMLKMFEDRLCHKTYLNGDHVTHPDFMLYDALDVVLYMDPMCLDAFPKLVCFKKRIEAIPQIDKYLKSSKYIAWPLQGWQATFGGGDHPPKMSIRGVGGNGNSRIPSHNGDGSNRRSQNTKGNNKVEDRVCSLYSSRSNENRESPYAVVDVSSMIESTPTSGETTRASRGVLSRFQRGLVRIADKVRRAVQCAWSSVSTSRSSATRAAESGSSSRTARGASSGYREYSPSAARGLRLMFTDFWRTRVLRQTSPMAGVFGNLDVNEARLMAAYTSECADHLEAKELAGPDGVAAAREIAKRWEKRVRDLQDKGAARKLLNDPLGRRTPNYQSKNPGEYTVGNSMFYDGPQVANLQNVDTGFWLDMQHLSDVVLSREIQTGLRARATLEESMPMLENLEERFRRLQETCDAARTEIEESGWTRESASRMEGDEAQGPSRVQQAFQSFVNECNSIEFSFGSFGEHVRVLCARVSRGLAAAGEAIRRCFSCCKGSTHRYAPRDDLSPEGASLAETLARFADDMGIERGADGTYDIPLVDDWRRGVPSIEGEGSHHHHHH

SEQ ID NO: 100 - protein, 478 aa, Artificial Sequence; identical to SEQ ID NO: 88
  Synthetic Polypeptide

SEQ ID NO: 101 - protein, 484 aa, Artificial Sequence; identical to SEQ ID NO: 84
  Synthetic Polypeptide

SEQ ID NO: 102 - protein, 594 aa, Artificial Sequence; identical to SEQ ID NO: 87
  Synthetic Polypeptide

SEQ ID NO: 103 - protein, 812 aa, Artificial Sequence
  Synthetic Polypeptide
METPAQLLFLLLLWLPDTTGMSPILGYWKIKGLVQPTRLLLEYLEEKYEEHLYERDEGDKWRNKKFELGLEFPNLPYYIDGDVKLTQSMAIIRYIADKHNMLGGCPKERAEISMLEGAVLDIRYGVSRIAYSKDFETLKVDFLSKLPEMLKMFEDRLCHKTYLNGDHVTHPDFMLYDALDVVLYMDPMCLDAFPKLVCFKKRIEAIPQIDKYLKSSKYIAWPLQGWQATFGGGDHPPKMSIRGVGGNGNSRIPSHNGDGSNRRSQNTKGNNKVEDRVCSLYSSRSNENRESPYAVVDVSSMIESTPTSGETTRASRGVLSRFQRGLVRIADKVRRAVQCAWSSVSTSRSSATRAAESGSSSRTARGASSGYREYSPSAARGLRLMFTDFWRTRVLRQTSPMAGVFGNLDVNEARLMAAYTSECADHLEAKELAGPDGVAAAREIAKRWEKRVRDLQDKGAARKLLNDPLGRRTPNYQSKNPGEYTVGNSMFYDGPQVANLQNVDTGFWLDMSNLSDVVLSREIQTGLRARATLEESMPMLENLEERFRRLQETCDAARTEIEESGWTRESASRMEGDEAQGPSRVQQAFQSFVNECNSIEFSFGSFGEHVRVLCARVSRGLAAAGEAIRRCFSCCKGSTHRYAPRDDLSPEGASLAETLARFADDMGIERGADGTYDIPLVDDWRRGVPSIEGEGSDSIYEIMMPIYEVMNMDLETRRSFAVQQGHYQDPRASDYDLPRASDYDLPRSPYPTPPLPPRYQLQNMDVEAGFREAVYASFVAGMYNYVVTQPQERIPNSQQVEGILRDMLTNGS

SEQ ID NO: 104 - protein, 818 aa, Artificial Sequence
  Synthetic Polypeptide
METPAQLLFLLLLWLPDTTGMSPILGYWKIKGLVQPTRLLLEYLEEKYEEHLYERDEGDKWRNKKFELGLEFPNLPYYIDGDVKLTQSMAIIRYIADKHNMLGGCPKERAEISMLEGAVLDIRYGVSRIAYSKDFETLKVDFLSKLPEMLKMFEDRLCHKTYLNGDHVTHPDFMLYDALDVVLYMDPMCLDAFPKLVCFKKRIEAIPQIDKYLKSSKYIAWPLQGWQATFGGGDHPPKMSIRGVGGNGNSRIPSHNGDGSNRRSQNTKGNNKVEDRVCSLYSSRSNENRESPYAVVDVSSMIESTPTSGETTRASRGVLSRFQRGLVRIADKVRRAVQCAWSSVSTSRSSATRAAESGSSSRTARGASSGYREYSPSAARGLRLMFTDFWRTRVLRQTSPMAGVFGNLDVNEARLMAAYTSECADHLEAKELAGPDGVAAAREIAKRWEKRVRDLQDKGAARKLLNDPLGRRTPNYQSKNPGEYTVGNSMFYDGPQVANLQNVDTGFWLDMSNLSDVVLSREIQTGLRARATLEESMPMLENLEERFRRLQETCDAARTEIEESGWTRESASRMEGDEAQGPSRVQQAFQSFVNECNSIEFSFGSFGEHVRVLCARVSRGLAAAGEAIRRCFSCCKGSTHRYAPRDDLSPEGASLAETLARFADDMGIERGADGTYDIPLVDDWRRGVPSIEGEGSDSIYEIMMPIYEVMNMDLETRRSFAVQQGHYQDPRASDYDLPRASDYDLPRSPYPTPPLPPRYQLQNMDVEAGFREAVYASFVAGMYNYVVTQPQERIPNSQQVEGILRDMLTNGSHHHHHH

SEQ ID NO: 105 - protein, 829 aa, Artificial Sequence; identical to SEQ ID NO: 82
  Synthetic Polypeptide

SEQ ID NO: 106 - protein, 835 aa, Artificial Sequence; identical to SEQ ID NO: 80
  Synthetic Polypeptide

SEQ ID NO: 107 - protein, 843 aa, Artificial Sequence; identical to SEQ ID NO: 78
  Synthetic Polypeptide

SEQ ID NO: 108 - protein, 849 aa, Artificial Sequence; identical to SEQ ID NO: 76
  Synthetic Polypeptide

SEQ ID NO: 109 - protein, 187 aa, Artificial Sequence
  Synthetic Polypeptide
METPAQLLFLLLLWLPDTTGMSRQNAEENLKNFAKELKLPDVAFDQNNACILFVDGEFSLHLTYEEHSDRLYVYAPLLDGLPDNPQRKLALYEKLLEGSMLGGQMAGGGVGVATKEQLILMHCVLDMKYAETNLLKAFAQLFIETVVKWRTVCSDISAGREPTVDTMPQMPQGGGGGIQPPPAGIRA

SEQ ID NO: 110 - protein, 193 aa, Artificial Sequence
  Synthetic Polypeptide
METPAQLLFLLLLWLPDTTGMSRQNAEENLKNFAKELKLPDVAFDQNNACILFVDGEFSLHLTYEEHSDRLYVYAPLLDGLPDNPQRKLALYEKLLEGSMLGGQMAGGGVGVATKEQLILMHCVLDMKYAETNLLKAFAQLFIETVVKWRTVCSDISAGREPTVDTMPQMPQGGGGGIQPPPAGIRAHHHHHH

SEQ ID NO: 111 - protein, 187 aa, Artificial Sequence
  Synthetic Polypeptide
METPAQLLFLLLLWLPDTTGMSRQNAEENLKNFAKELKLPDVAFDQNNTCILFVDGEFSLHLTYEEHSDRLYVYAPLLDGLPDNPQRKLALYEKLLEGSMLGGQMAGGGVGVATKEQLILMHCVLDMKYAETNLLKAFAQLFIETVVKWRTVCSDISAGREPTVDTMPQMPQGGGGGIQPPPAGIRA

SEQ ID NO: 112 - protein, 193 aa, Artificial Sequence
  Synthetic Polypeptide
METPAQLLFLLLLWLPDTTGMSRQNAEENLKNFAKELKLPDVAFDQNNTCILFVDGEFSLHLTYEEHSDRLYVYAPLLDGLPDNPQRKLALYEKLLEGSMLGGQMAGGGVGVATKEQLILMHCVLDMKYAETNLLKAFAQLFIETVVKWRTVCSDISAGREPTVDTMPQMPQGGGGGIQPPPAGIRAHHHHHH

SEQ ID NO: 113 - protein, 1199 aa, Artificial Sequence
  Synthetic Polypeptide
METPAQLLFLLLLWLPDTTGSCVDLHAGGQSVNELVYVGPQAVLLLDQIRDLFVGSKDSQAEGQYRLIVGDPSSFQEKDADTLPGKVEQSTLFSVTNPVVFQGVDQQDQVSSQGLICSFTSSNLDSPRDGESFLGIAFVGDSSKAGITLTDVKASLSGAALYSTEDLIFEKIKGGLEFASCSSLEQGGACAAQSILIHDCQGLQVKHCTTAVNAEGSSANDHLGFGGGAFFVTGSLSGEKSLYMPAGDMVVANCDGAISFEGNSANFANGGAIAASGKVLFVANDKKTSFIENRALSGGAIAASSDIAFQNCAELVFKGNCAIGTEDKGSLGGGAISSLGTVLLQGNHGITCDKNESASQGGAIFGKNCQISDNEGPVVFRDSTACLGGGAIAAQEIVSIQNNQAGISFEGGKASFGGGIACGSFSSAGGASVLGTIDISKNLGAISFSRTLCTTSDLGQMEYQGGGALFGENISLSENAGVLTFKDNIVKTFASNGKILGGGAILATGKVEITNNSEGISFTGNARAPQALPTQEEFPLFSKKEGRPLSSGYSGGGAILGREVAILHNAAVVFEQNRLQCSEEEATLLGCCGGGAVHGMDSTSIVGNSSVRFGNNYAMGQGVSGGALLSKTVQLAGNGSVDFSRNIASLGGGALQASEGNCELVDNGYVLFRDNRGRVYGGAISCLRGDVVISGNKGRVEFKDNIATRLYVEETVEKVEEVEPAPEQKDNNELSFLGRAEQSFITAANQALFASEDGDLSPESSISSEELAKRRECAGGAIFAKRVRIVDNQEAVVFSNNFSDIYGGAIFTGSLREEDKLDGQIPEVLISGNAGDVVFSGNSSKRDEHLPHTGGGAICTQNLTISQNTGNVLFYNNVACSGGAVRIEDHGNVLLEAFGGDIVFKGNSSFRAQGSDAIYFAGKESHITALNATEGHAIVFHDALVFENLEERKSAEVLLINSRENPGYTGSIRFLEAESKVPQCIHVQQGSLELLNGATLCSYGFKQDAGAKLVLAAGAKLKILDSGTPVQQGHAISKPEAEIESSSEPEGAHSLWIAKNAQTTVPMVDIHTISVDLASFSSSQQEGTVEAPQVIVPGGSYVRSGELNLELVNTTGTGYENHALLKNEAKVPLMSFVASGDEASAEISNLSVSDLQIHVVTPEIEEDTYGHMGDWSEAKIQDGTLVISWNPTGHHHHHH

SEQ ID NO: 114 - protein, 1193 aa, Artificial Sequence
  Synthetic Polypeptide
METPAQLLFLLLLWLPDTTGSCVDLHAGGQSVNELVYVGPQAVLLLDQIRDLFVGSKDSQAEGQYRLIVGDPSSFQEKDADTLPGKVEQSTLFSVTNPVVFQGVDQQDQVSSQGLICSFTSSNLDSPRDGESFLGIAFVGDSSKAGITLTDVKASLSGAALYSTEDLIFEKIKGGLEFASCSSLEQGGACAAQSILIHDCQGLQVKHCTTAVNAEGSSANDHLGFGGGAFFVTGSLSGEKSLYMPAGDMVVANCDGAISFEGNSANFANGGAIAASGKVLFVANDKKTSFIENRALSGGAIAASSDIAFQNCAELVFKGNCAIGTEDKGSLGGGAISSLGTVLLQGNHGITCDKNESASQGGAIFGKNCQISDNEGPVVFRDSTACLGGGAIAAQEIVSIQNNQAGISFEGGKASFGGGIACGSFSSAGGASVLGTIDISKNLGAISFSRTLCTTSDLGQMEYQGGGALFGENISLSENAGVLTFKDNIVKTFASNGKILGGGAILATGKVEITNNSEGISFTGNARAPQALPTQEEFPLFSKKEGRPLSSGYSGGGAILGREVAILHNAAVVFEQNRLQCSEEEATLLGCCGGGAVHGMDSTSIVGNSSVRFGNNYAMGQGVSGGALLSKTVQLAGNGSVDFSRNIASLGGGALQASEGNCELVDNGYVLFRDNRGRVYGGAISCLRGDVVISGNKGRVEFKDNIATRLYVEETVEKVEEVEPAPEQKDNNELSFLGRAEQSFITAANQALFASEDGDLSPESSISSEELAKRRECAGGAIFAKRVRIVDNQEAVVFSNNFSDIYGGAIFTGSLREEDKLDGQIPEVLISGNAGDVVFSGNSSKRDEHLPHTGGGAICTQNLTISQNTGNVLFYNNVACSGGAVRIEDHGNVLLEAFGGDIVFKGNSSFRAQGSDAIYFAGKESHITALNATEGHAIVFHDALVFENLEERKSAEVLLINSRENPGYTGSIRFLEAESKVPQCIHVQQGSLELLNGATLCSYGFKQDAGAKLVLAAGAKLKILDSGTPVQQGHAISKPEAEIESSSEPEGAHSLWIAKNAQTTVPMVDIHTISVDLASFSSSQQEGTVEAPQVIVPGGSYVRSGELNLELVNTTGTGYENHALLKNEAKVPLMSFVASGDEASAEISNLSVSDLQIHVVTPEIEEDTYGHMGDWSEAKIQDGTLVISWNPTG

SEQ ID NO: 115 - protein, 1193 aa, Artificial Sequence
  Synthetic Polypeptide
METPAQLLFLLLLWLPDTTGSCVDLHAGGQSVNELVYVGPQAVLLLDQIRDLFVGSKDSQAEGQYRLIVGDPSSFQEKDADTLPGKVEQSTLFSVTNPVVFQGVDQQDQVSSQGLICSFTSSNLDSPRDGESFLGIAFVGDSSKAGITLTDVKASLSGAALYSTEDLIFEKIKGGLEFASCSSLEQGGACAAQSILIHDCQGLQVKHCTTAVNAEGSSANDHLGFGGGAFFVTGSLSGEKSLYMPAGDMVVANCDGAISFEGNSANFANGGAIAASGKVLFVANDKKTSFIENRALSGGAIAASSDIAFQNCAELVFKGNCAIGTEDKGSLGGGAISSLGTVLLQGNHGITCDKNEAASQGGAIFGKNCQISDNEGPVVFRDSTACLGGGAIAAQEIVSIQNNQAGISFEGGKASFGGGIACGSFSSAGGASVLGTIDISKNLGAISFSRTLCTTSDLGQMEYQGGGALFGENIALSENAGVLTFKDNIVKTFASNGKILGGGAILATGKVEITNNAEGISFTGNARAPQALPTQEEFPLFSKKEGRPLSSGYSGGGAILGREVAILHNAAVVFEQNRLQCSEEEATLLGCCGGGAVHGMDSTSIVGNSAVRFGNNYAMGQGVSGGALLSKTVQLAGNGAVDFSRNIASLGGGALQASEGNCELVDNGYVLFRDNRGRVYGGAISCLRGDVVISGNKGRVEFKDNIATRLYVEETVEKVEEVEPAPEQKDNNELSFLGRAEQSFITAANQALFASEDGDLSPESSISSEELAKRRECAGGAIFAKRVRIVDNQEAVVFSNNFADIYGGAIFTGSLREEDKLDGQIPEVLISGNAGDVVFSGNSAKRDEHLPHTGGGAICTQNLAISQNTGNVLFYNNVACSGGAVRIEDHGNVLLEAFGGDIVFKGNSAFRAQGSDAIYFAGKESHITALNAAEGHAIVFHDALVFENLEERKSAEVLLINSRENPGYTGSIRFLEAESKVPQCIHVQQGSLELLNGATLCSYGFKQDAGAKLVLAAGAKLKILDSGTPVQQGHAISKPEAEIESSSEPEGAHSLWIAKNAQTTVPMVDIHTISVDLASFSSSQQEGTVEAPQVIVPGGSYVRSGELNLELVNTAGTGYENHALLKNEAKVPLMSFVASGDEASAEISNLAVSDLQIHVVTPEIEEDTYGHMGDWSEAKIQDGTLVISWNPAG

SEQ ID NO: 116 - protein, 1199 aa, Artificial Sequence
  Synthetic Polypeptide
METPAQLLFLLLLWLPDTTGSCVDLHAGGQSVNELVYVGPQAVLLLDQIRDLFVGSKDSQAEGQYRLIVGDPSSFQEKDADTLPGKVEQSTLFSVTNPVVFQGVDQQDQVSSQGLICSFTSSNLDSPRDGESFLGIAFVGDSSKAGITLTDVKASLSGAALYSTEDLIFEKIKGGLEFASCSSLEQGGACAAQSILIHDCQGLQVKHCTTAVNAEGSSANDHLGFGGGAFFVTGSLSGEKSLYMPAGDMVVANCDGAISFEGNSANFANGGAIAASGKVLFVANDKKTSFIENRALSGGAIAASSDIAFQNCAELVFKGNCAIGTEDKGSLGGGAISSLGTVLLQGNHGITCDKNEAASQGGAIFGKNCQISDNEGPVVFRDSTACLGGGAIAAQEIVSIQNNQAGISFEGGKASFGGGIACGSFSSAGGASVLGTIDISKNLGAISFSRTLCTTSDLGQMEYQGGGALFGENIALSENAGVLTFKDNIVKTFASNGKILGGGAILATGKVEITNNAEGISFTGNARAPQALPTQEEFPLFSKKEGRPLSSGYSGGGAILGREVAILHNAAVVFEQNRLQCSEEEATLLGCCGGGAVHGMDSTSIVGNSAVRFGNNYAMGQGVSGGALLSKTVQLAGNGAVDFSRNIASLGGGALQASEGNCELVDNGYVLFRDNRGRVYGGAISCLRGDVVISGNKGRVEFKDNIATRLYVEETVEKVEEVEPAPEQKDNNELSFLGRAEQSFITAANQALFASEDGDLSPESSISSEELAKRRECAGGAIFAKRVRIVDNQEAVVFSNNFADIYGGAIFTGSLREEDKLDGQIPEVLISGNAGDVVFSGNSAKRDEHLPHTGGGAICTQNLAISQNTGNVLFYNNVACSGGAVRIEDHGNVLLEAFGGDIVFKGNSAFRAQGSDAIYFAGKESHITALNAAEGHAIVFHDALVFENLEERKSAEVLLINSRENPGYTGSIRFLEAESKVPQCIHVQQGSLELLNGATLCSYGFKQDAGAKLVLAAGAKLKILDSGTPVQQGHAISKPEAEIESSSEPEGAHSLWIAKNAQTTVPMVDIHTISVDLASFSSSQQEGTVEAPQVIVPGGSYVRSGELNLELVNTAGTGYENHALLKNEAKVPLMSFVASGDEASAEISNLAVSDLQIHVVTPEIEEDTYGHMGDWSEAKIQDGTLVISWNPAGHHHHHH

SEQ ID NO: 117 - protein, 690 aa, Artificial Sequence
  Synthetic Polypeptide
METPAQLLFLLLLWLPDTTGAEIMIPQGIYDGETLTVSFPYTVIGDPSGTTVFSAGELTLKNLDNSIAALPLSCFGNLLGSFTVLGRGHSLTFENIRTSTNGAALSDSANSGLFTIEGFKELSFSNCNSLLAVLPAATTNSGSQTPTTTSTPSNGAIYSKTDLLLLNNEKFSFYSNLVSGDGGAIDAKSLTVQGISKLCVFQENTAQADGGACQVVTSFSAMANEAPIAFIANVAGVRGGGIAAVQDGQQGVSSSTSTEDPVVSFSRNTAVEFDGNVARVGGGIYSYGNVAFLNNGKTLFLNNVASPVYIAAEQPTNGQASNTADNYGDGGAIFCKNGAQAAGSNNAGSVSFDGEGVVFFSSNVAAGKGGAIYAKKLSVANCGPVQFLGNIANDGGAIYLGESGELSLSADYGDIIFDGNLKRTAKENAADVNGVTVSSQAISMGSGGKITTLRAKAGHQILFNDPIEMANGNNQPAQSSEPLKINDGEGYTGDIVFANGNSALYQNVAIEQGRIVLREKAKLSVNSLSQTGGSLYMEAGSTLDFVTPQPPQQPPAANQLITLSNLHLSLSSLLANNAVTNPPTNPPAQDSHPAIIGSTTAGSVTISGPIFFEDLDDTAYDRYDWLGSNQKIDVLKLQLGTQPSANAPSDLTLGNEMPKYGYQGSWKLAWDPNTANNGPYTLKATWTKTG

SEQ ID NO: 118 - protein, 696 aa, Artificial Sequence
  Synthetic Polypeptide
METPAQLLFLLLLWLPDTTGAEIMIPQGIYDGETLTVSFPYTVIGDPSGTTVFSAGELTLKNLDNSIAALPLSCFGNLLGSFTVLGRGHSLTFENIRTSTNGAALSDSANSGLFTIEGFKELSFSNCNSLLAVLPAATTNSGSQTPTTTSTPSNGAIYSKTDLLLLNNEKFSFYSNLVSGDGGAIDAKSLTVQGISKLCVFQENTAQADGGACQVVTSFSAMANEAPIAFIANVAGVRGGGIAAVQDGQQGVSSSTSTEDPVVSFSRNTAVEFDGNVARVGGGIYSYGNVAFLNNGKTLFLNNVASPVYIAAEQPTNGQASNTADNYGDGGAIFCKNGAQAAGSNNAGSVSFDGEGVVFFSSNVAAGKGGAIYAKKLSVANCGPVQFLGNIANDGGAIYLGESGELSLSADYGDIIFDGNLKRTAKENAADVNGVTVSSQAISMGSGGKITTLRAKAGHQILFNDPIEMANGNNQPAQSSEPLKINDGEGYTGDIVFANGNSALYQNVAIEQGRIVLREKAKLSVNSLSQTGGSLYMEAGSTLDFVTPQPPQQPPAANQLITLSNLHLSLSSLLANNAVTNPPTNPPAQDSHPAIIGSTTAGSVTISGPIFFEDLDDTAYDRYDWLGSNQKIDVLKLQLGTQPSANAPSDLTLGNEMPKYGYQGSWKLAWDPNTANNGPYTLKATWTKTGHHHHHH

SEQ ID NO: 119 - protein, 106 aa, Artificial Sequence
  Synthetic Polypeptide
METPAQLLFLLLLWLPDTTGMSQNKNSAFMQPVNVAADLAAIVGAGPMPRTEIIKKMWDYIKKNGLQDPTNKRNINPDDKLAKVFGTEKPIDMFQMTKMVSQHIIK

SEQ ID NO: 120 - protein, 112 aa, Artificial Sequence
  Synthetic Polypeptide
METPAQLLFLLLLWLPDTTGMSQNKNSAFMQPVNVAADLAAIVGAGPMPRTEIIKKMWDYIKKNGLQDPTNKRNINPDDKLAKVFGTEKPIDMFQMTKMVSQHIIKHHHHHH

SEQ ID NO: 121 - protein, 611 aa, Artificial Sequence
  Synthetic Polypeptide
METPAQLLFLLLLWLPDTTGMSIRGVGGNGNSRIPSHNGDGSNRRSQNTKGNNKVEDRVCSLYSSRSNENRESPYAVVDVSSMIESTPTSGETTRASRGVLSRFQRGLVRIADKVRRAVQCAWSSVSTSRSSATRAAESGSSSRTARGASSGYREYSPSAARGLRLMFTDFWRTRVLRQTSPMAGVFGNLDVNEARLMAAYTSECADHLEAKELAGPDGVAAAREIAKRWEKRVRDLQDKGAARKLLNDPLGRRTPNYQSKNPGEYTVGNSMFYDGPQVANLQNVDTGFWLDMQHLSDVVLSREIQTGLRARATLEESMPMLENLEERFRRLQETCDAARTEIEESGWTRESASRMEGDEAQGPSRVQQAFQSFVNECNSIEFSFGSFGEHVRVLCARVSRGLAAAGEAIRRCFSCCKGSTHRYAPRDDLSPEGASLAETLARFADDMGIERGADGTYDIPLVDDWRRGVPSIEGEGSDSIYEIMMPIYEVMNMDLETRRSFAVQQGHYQDPRASDYDLPRASDYDLPRSPYPTPPLPPRYQLQNMDVEAGFREAVYASFVAGMYNYVVTQPQERIPNSQQVEGILRDMLTNGDQTFRDLMKRWNREVDRE

SEQ ID NO: 122 - protein, 617 aa, Artificial Sequence
  Synthetic Polypeptide
METPAQLLFLLLLWLPDTTGMSIRGVGGNGNSRIPSHNGDGSNRRSQNTKGNNKVEDRVCSLYSSRSNENRESPYAVVDVSSMIESTPTSGETTRASRGVLSRFQRGLVRIADKVRRAVQCAWSSVSTSRSSATRAAESGSSSRTARGASSGYREYSPSAARGLRLMFTDFWRTRVLRQTSPMAGVFGNLDVNEARLMAAYTSECADHLEAKELAGPDGVAAAREIAKRWEKRVRDLQDKGAARKLLNDPLGRRTPNYQSKNPGEYTVGNSMFYDGPQVANLQNVDTGFWLDMQHLSDVVLSREIQTGLRARATLEESMPMLENLEERFRRLQETCDAARTEIEESGWTRESASRMEGDEAQGPSRVQQAFQSFVNECNSIEFSFGSFGEHVRVLCARVSRGLAAAGEAIRRCFSCCKGSTHRYAPRDDLSPEGASLAETLARFADDMGIERGADGTYDIPLVDDWRRGVPSIEGEGSDSIYEIMMPIYEVMNMDLETRRSFAVQQGHYQDPRASDYDLPRASDYDLPRSPYPTPPLPPRYQLQNMDVEAGFREAVYASFVAGMYNYVVTQPQERIPNSQQVEGILRDMLTNGDQTFRDLMKRWNREVDREHHHHHH

SEQ ID NO: 123 - protein, 673 aa, Artificial Sequence
  Synthetic Polypeptide
METPAQLLFLLLLWLPDTTGMESGPESVSSNQNSMNPIINGQIASNSETKESTKASEASPSASSSVSSWSFLSSAKNALISLRDAILNKNSSPTDSLSQLEASTSTSTVTRVAAKDYDEAKSNFDTAKSGLENAKTLAEYETKMADLMAALQDMERLANSDPSNNHTEEVNNIKKALEAQKDTIDKLNKLVTLQNQNKALTEVLKTTDSADQIPAINSQLEINKNSADQIIKDLERQNINYEAVLTNAGEVIKASSEAGIKLGQALQSIVDAGDQSQAAVLQAQQNNSPDNIAATKELIDAAETKVNELKQEHTGLTDSPLVKKAEEQISQAQKDIQEIKPSGSDIPIVGPSGSAASAGSAAGALKSSNNSGRISLLLDDVDNEMAAIALQGFRSMIEQFNVNNPATAKELQAMEAQLTAMSDQLVGADGELPAEIQAIKDALAQALKQPSADGLATAMGQVAFAAAKVGGGSAGTAGTVQMNVKQLYKTAFSSTSSSSYAAALSDGYSAYKTLNSLYSESRSGVQSAISQTANPALSRSVSRSGIESQGRSADASQRAAETIVRDSQTLGDVYSRLQVLDSLMSTIVSNPQANQEEIMQKLTASISKAPQFGYPAVQNSADSLQKFAAQLEREFVDGERSLAESQENAFRKQPAFIQQVLVNIASLFSGYLS

SEQ ID NO: 124 - protein, 679 aa, Artificial Sequence
  Synthetic Polypeptide
METPAQLLFLLLLWLPDTTGMESGPESVSSNQNSMNPIINGQIASNSETKESTKASEASPSASSSVSSWSFLSSAKNALISLRDAILNKNSSPTDSLSQLEASTSTSTVTRVAAKDYDEAKSNFDTAKSGLENAKTLAEYETKMADLMAALQDMERLANSDPSNNHTEEVNNIKKALEAQKDTIDKLNKLVTLQNQNKALTEVLKTTDSADQIPAINSQLEINKNSADQIIKDLERQNINYEAVLTNAGEVIKASSEAGIKLGQALQSIVDAGDQSQAAVLQAQQNNSPDNIAATKELIDAAETKVNELKQEHTGLTDSPLVKKAEEQISQAQKDIQEIKPSGSDIPIVGPSGSAASAGSAAGALKSSNNSGRISLLLDDVDNEMAAIALQGFRSMIEQFNVNNPATAKELQAMEAQLTAMSDQLVGADGELPAEIQAIKDALAQALKQPSADGLATAMGQVAFAAAKVGGGSAGTAGTVQMNVKQLYKTAFSSTSSSSYAAALSDGYSAYKTLNSLYSESRSGVQSAISQTANPALSRSVSRSGIESQGRSADASQRAAETIVRDSQTLGDVYSRLQVLDSLMSTIVSNPQANQEEIMQKLTASISKAPQFGYPAVQNSADSLQKFAAQLEREFVDGERSLAESQENAFRKQPAFIQQVLVNIASLFSGYLSHHHHHH

SEQ ID NO: 125 - protein, 136 aa, Artificial Sequence
  Synthetic Polypeptide
METPAQLLFLLLLWLPDTTGPSSTQDNRSMDQQDSEEFLLQNTLEDSEIISIPDTMNQIAIDTEKWFYLNKDCTNVGPISIVQLTAFLKECKHSPEKGIDPQELWVWKKGMPNWEKVKNIPELSGTVKDEHHHHHH

SEQ ID NO: 126 - protein, 130 aa, Artificial Sequence
  Synthetic Polypeptide
METPAQLLFLLLLWLPDTTGPSSTQDNRSMDQQDSEEFLLQNTLEDSEIISIPDTMNQIAIDTEKWFYLNKDCTNVGPISIVQLTAFLKECKHSPEKGIDPQELWVWKKGMPNWEKVKNIPELSGTVKDE

SEQ ID NO: 127 - protein, 172 aa, Artificial Sequence
  Synthetic Polypeptide
MNSGMFPFTFFLLYICLGMLTAYLANKKNRNLIGWFLAGMFFGIFAIIFLLILPPLPSSTQDNRSMDQQDSEEFLLQNTLEDSEIISIPDTMNQIAIDTEKWFYLNKDCTNVGPISIVQLTAFLKECKHSPEKGIDPQELWVWKKGMPNWEKVKNIPELSGTVKDEHHHHHH

SEQ ID NO: 128 - protein, 166 aa, Artificial Sequence
  Synthetic Polypeptide
MNSGMFPFTFFLLYICLGMLTAYLANKKNRNLIGWFLAGMFFGIFAIIFLLILPPLPSSTQDNRSMDQQDSEEFLLQNTLEDSEIISIPDTMNQIAIDTEKWFYLNKDCTNVGPISIVQLTAFLKECKHSPEKGIDPQELWVWKKGMPNWEKVKNIPELSGTVKDE

SEQ ID NO: 129 - protein, 551 aa, Artificial Sequence
  Synthetic Polypeptide
METPAQLLFLLLLWLPDTTGSGVLETSMAESLSTNVISLADTKAKDNTSHKSKKARKNHSKETLVDRKEVAPVHESKATGPKQDSCFGRMYTVKVNDDRNVEITQAVPEYATVGSPYPIEITATGKRDCVDVIITQQLPCEAEFVRSDPATTPTADGKLVWKIDRLGQGEKSKITVWVKPLKEGCCFTAATVCACPEIRSVTKCGQPAICVKQEGPENACLRCPVVYKINVVNQGTAIARNVVVENPVPDGYAHSSGQRVLTFTLGDMQPGEHRTITVEFCPLKRGRATNIATVSYCGGHKNTASVTTVINEPCVQVSIAGADWSYVCKPVEYVISVSNPGDLVLRDVVVEDTLSPGVTVLEAAGAQISCNKVVWTVKELNPGESLQYKVLVRAQTPGQFTNNVVVKSCSDCGTCTSCAEATTYWKGVAATHMCVVDTCDPVCVGENTVYRICVTNRGSAEDTNVSLMLKFSKELQPVSFSGPTKGTITGNTVVFDSLPRLGSKETVEFSVTLKAVSAGDARGEAILSSDTLTVPVSDTENTHIYHHHHHH

SEQ ID NO: 130 - protein, 545 aa, Artificial Sequence
  Synthetic Polypeptide
METPAQLLFLLLLWLPDTTGSGVLETSMAESLSTNVISLADTKAKDNTSHKSKKARKNHSKETLVDRKEVAPVHESKATGPKQDSCFGRMYTVKVNDDRNVEITQAVPEYATVGSPYPIEITATGKRDCVDVIITQQLPCEAEFVRSDPATTPTADGKLVWKIDRLGQGEKSKITVWVKPLKEGCCFTAATVCACPEIRSVTKCGQPAICVKQEGPENACLRCPVVYKINVVNQGTAIARNVVVENPVPDGYAHSSGQRVLTFTLGDMQPGEHRTITVEFCPLKRGRATNIATVSYCGGHKNTASVTTVINEPCVQVSIAGADWSYVCKPVEYVISVSNPGDLVLRDVVVEDTLSPGVTVLEAAGAQISCNKVVWTVKELNPGESLQYKVLVRAQTPGQFTNNVVVKSCSDCGTCTSCAEATTYWKGVAATHMCVVDTCDPVCVGENTVYRICVTNRGSAEDTNVSLMLKFSKELQPVSFSGPTKGTITGNTVVFDSLPRLGSKETVEFSVTLKAVSAGDARGEAILSSDTLTVPVSDTENTHIY

SEQ ID NO: 131 - protein, 611 aa, Artificial Sequence
  Synthetic Polypeptide
METPAQLLFLLLLWLPDTTGMSIRGVGGNGNSRIPSHNGDGSNRRSQNTKGNNKVEDRVCSLYSSRSNENRESPYAVVDVSSMIESTPTSGETTRASRGVLSRFQRGLVRIADKVRRAVQCAWSSVSTSRSSATRAAESGSSSRTARGASSGYREYSPSAARGLRLMFTDFWRTRVLRQTSPMAGVFGNLDVNEARLMAAYTSECADHLEAKELAGPDGVAAAREIAKRWEKRVRDLQDKGAARKLLNDPLGRRTPNYQSKNPGEYTVGNSMFYDGPQVANLQNVDTGFWLDMSNLSDVVLSREIQTGLRARATLEESMPMLENLEERFRRLQETCDAARTEIEESGWTRESASRMEGDEAQGPSRVQQAFQSFVNECNSIEFSFGSFGEHVRVLCARVSRGLAAAGEAIRRCFSCCKGSTHRYAPRDDLSPEGASLAETLARFADDMGIERGADGTYDIPLVDDWRRGVPSIEGEGSDSIYEIMMPIYEVMNMDLETRRSFAVQQGHYQDPRASDYDLPRASDYDLPRSPYPTPPLPPRYQLQNMDVEAGFREAVYASFVAGMYNYVVTQPQERIPNSQQVEGILRDMLTNGSQTFRDLMKRWNREVDRE

SEQ ID NO: 132 - protein, 611 aa, Artificial Sequence; identical to SEQ ID NO: 131
  Synthetic Polypeptide

SEQ ID NO: 133 - protein, 611 aa, Artificial Sequence; identical to SEQ ID NO: 131
  Synthetic Polypeptide

SEQ ID NO: 134 - protein, 611 aa, Artificial Sequence; identical to SEQ ID NO: 131
  Synthetic Polypeptide

SEQ ID NO: 135 - protein, 617 aa, Artificial Sequence
  Synthetic Polypeptide
METPAQLLFLLLLWLPDTTGMSIRGVGGNGNSRIPSHNGDGSNRRSQNTKGNNKVEDRVCSLYSSRSNENRESPYAVVDVSSMIESTPTSGETTRASRGVLSRFQRGLVRIADKVRRAVQCAWSSVSTSRSSATRAAESGSSSRTARGASSGYREYSPSAARGLRLMFTDFWRTRVLRQTSPMAGVFGNLDVNEARLMAAYTSECADHLEAKELAGPDGVAAAREIAKRWEKRVRDLQDKGAARKLLNDPLGRRTPNYQSKNPGEYTVGNSMFYDGPQVANLQNVDTGFWLDMSNLSDVVLSREIQTGLRARATLEESMPMLENLEERFRRLQETCDAARTEIEESGWTRESASRMEGDEAQGPSRVQQAFQSFVNECNSIEFSFGSFGEHVRVLCARVSRGLAAAGEAIRRCFSCCKGSTHRYAPRDDLSPEGASLAETLARFADDMGIERGADGTYDIPLVDDWRRGVPSIEGEGSDSIYEIMMPIYEVMNMDLETRRSFAVQQGHYQDPRASDYDLPRASDYDLPRSPYPTPPLPPRYQLQNMDVEAGFREAVYASFVAGMYNYVVTQPQERIPNSQQVEGILRDMLTNGSQTFRDLMKRWNREVDREHHHHHH

SEQ ID NO: 136 - protein, 617 aa, Artificial Sequence; identical to SEQ ID NO: 135
  Synthetic Polypeptide

SEQ ID NO: 137 - protein, 617 aa, Artificial Sequence; identical to SEQ ID NO: 135
  Synthetic Polypeptide

SEQ ID NO: 138 - protein, 617 aa, Artificial Sequence; identical to SEQ ID NO: 135
  Synthetic Polypeptide

SEQ ID NO: 139 - protein, 617 aa, Artificial Sequence; identical to SEQ ID NO: 135
  Synthetic Polypeptide

SEQ ID NO: 140 - protein, 633 aa, Artificial Sequence
  Synthetic Polypeptide
METPAQLLFLLLLWLPDTTGDYKDHDGDYKDHDIDYKDDDDKMSIRGVGGNGNSRIPSHNGDGSNRRSQNTKGNNKVEDRVCSLYSSRSNENRESPYAVVDVSSMIESTPTSGETTRASRGVLSRFQRGLVRIADKVRRAVQCAWSSVSTSRSSATRAAESGSSSRTARGASSGYREYSPSAARGLRLMFTDFWRTRVLRQTSPMAGVFGNLDVNEARLMAAYTSECADHLEAKELAGPDGVAAAREIAKRWEKRVRDLQDKGAARKLLNDPLGRRTPNYQSKNPGEYTVGNSMFYDGPQVANLQNVDTGFWLDMSNLSDVVLSREIQTGLRARATLEESMPMLENLEERFRRLQETCDAARTEIEESGWTRESASRMEGDEAQGPSRVQQAFQSFVNECNSIEFSFGSFGEHVRVLCARVSRGLAAAGEAIRRCFSCCKGSTHRYAPRDDLSPEGASLAETLARFADDMGIERGADGTYDIPLVDDWRRGVPSIEGEGSDSIYEIMMPIYEVMNMDLETRRSFAVQQGHYQDPRASDYDLPRASDYDLPRSPYPTPPLPPRYQLQNMDVEAGFREAVYASFVAGMYNYVVTQPQERIPNSQQVEGILRDMLTNGSQTFRDLMKRWNREVDRE

SEQ ID NO: 141 - protein, 633 aa, Artificial Sequence
  Synthetic Polypeptide
METPAQLLFLLLLWLPDTTGMSIRGVGGNGNSRIPSHNGDGSNRRSQNTKGNNKVEDRVCSLYSSRSNENRESPYAVVDVSSMIESTPTSGETTRASRGVLSRFQRGLVRIADKVRRAVQCAWSSVSTSRSSATRAAESGSSSRTARGASSGYREYSPSAARGLRLMFTDFWRTRVLRQTSPMAGVFGNLDVNEARLMAAYTSECADHLEAKELAGPDGVAAAREIAKRWEKRVRDLQDKGAARKLLNDPLGRRTPNYQSKNPGEYTVGNSMFYDGPQVANLQNVDTGFWLDMSNLSDVVLSREIQTGLRARATLEESMPMLENLEERFRRLQETCDAARTEIEESGWTRESASRMEGDEAQGPSRVQQAFQSFVNECNSIEFSFGSFGEHVRVLCARVSRGLAAAGEAIRRCFSCCKGSTHRYAPRDDLSPEGASLAETLARFADDMGIERGADGTYDIPLVDDWRRGVPSIEGEGSDSIYEIMMPIYEVMNMDLETRRSFAVQQGHYQDPRASDYDLPRASDYDLPRSPYPTPPLPPRYQLQNMDVEAGFREAVYASFVAGMYNYVVTQPQERIPNSQQVEGILRDMLTNGSQTFRDLMKRWNREVDREDYKDHDGDYKDHDIDYKDDDDK

SEQ ID NO: 142 - protein, 617 aa, Artificial Sequence
  Synthetic Polypeptide
METPAQLLFLLLLWLPDTTGHHHHHHMSIRGVGGNGNSRIPSHNGDGSNRRSQNTKGNNKVEDRVCSLYSSRSNENRESPYAVVDVSSMIESTPTSGETTRASRGVLSRFQRGLVRIADKVRRAVQCAWSSVSTSRSSATRAAESGSSSRTARGASSGYREYSPSAARGLRLMFTDFWRTRVLRQTSPMAGVFGNLDVNEARLMAAYTSECADHLEAKELAGPDGVAAAREIAKRWEKRVRDLQDKGAARKLLNDPLGRRTPNYQSKNPGEYTVGNSMFYDGPQVANLQNVDTGFWLDMSNLSDVVLSREIQTGLRARATLEESMPMLENLEERFRRLQETCDAARTEIEESGWTRESASRMEGDEAQGPSRVQQAFQSFVNECNSIEFSFGSFGEHVRVLCARVSRGLAAAGEAIRRCFSCCKGSTHRYAPRDDLSPEGASLAETLARFADDMGIERGADGTYDIPLVDDWRRGVPSIEGEGSDSIYEIMMPIYEVMNMDLETRRSFAVQQGHYQDPRASDYDLPRASDYDLPRSPYPTPPLPPRYQLQNMDVEAGFREAVYASFVAGMYNYVVTQPQERIPNSQQVEGILRDMLTNGSQTFRDLMKRWNREVDRE

SEQ ID NO: 143 - protein, 393 aa, Artificial Sequence
  Synthetic Polypeptide
MGPGRCLLTALLLLALAPPPEALPVGNPAEPSLMIDGILWEGFGGDPCDPCTTWCDAISMRMGYYGDFVFDRVLKTDVNKEFQMGDKPTSTTGNATAPTTLTARENPAYGRHMQDAEMFTNAACMALNIWDRFDVFCTLGASSGYLKGNSASFNLVGLFGDNENQSTVKTNSVPNMSLDQSVVELYTDTAFSWSVGARAALWECGCATLGASFQYAQSKPKVEELNVLCNAAEFTINKPKGYVGQEFPLALIAGTDAATGTKDASIDYHEWQASLALSYRLNMFTPYIGVKWSRASFDADTIRIAQPKSATAIFDTTTLNPTIAGAGDVKASAEGQLGDTMQIVSLQLNKMKSRKSCGIAVGTTIVDADKYAVTVETRLIDERAAHVNAQFRF

SEQ ID NO: 144 - protein, 399 aa, Artificial Sequence
  Synthetic Polypeptide
MGPGRCLLTALLLLALAPPPEALPVGNPAEPSLMIDGILWEGFGGDPCDPCTTWCDAISMRMGYYGDFVFDRVLKTDVNKEFQMGDKPTSTTGNATAPTTLTARENPAYGRHMQDAEMFTNAACMALNIWDRFDVFCTLGASSGYLKGNSASFNLVGLFGDNENQSTVKTNSVPNMSLDQSVVELYTDTAFSWSVGARAALWECGCATLGASFQYAQSKPKVEELNVLCNAAEFTINKPKGYVGQEFPLALIAGTDAATGTKDASIDYHEWQASLALSYRLNMFTPYIGVKWSRASFDADTIRIAQPKSATAIFDTTTLNPTIAGAGDVKASAEGQLGDTMQIVSLQLNKMKSRKSCGIAVGTTIVDADKYAVTVETRLIDERAAHVNAQFRFHHHHHH

SEQ ID NO: 145 - protein, 406 aa, Artificial Sequence
  Synthetic Polypeptide
MGLQTTKWPSHGAFFLKSWLIISLGLYSQVSKLLALPVGNPAEPSLMIDGILWEGFGGDPCDPCTTWCDAISMRMGYYGDFVFDRVLKTDVNKEFQMGDKPTSTTGNATAPTTLTARENPAYGRHMQDAEMFTNAACMALNIWDRFDVFCTLGASSGYLKGNSASFNLVGLFGDNENQSTVKTNSVPNMSLDQSVVELYTDTAFSWSVGARAALWECGCATLGASFQYAQSKPKVEELNVLCNAAEFTINKPKGYVGQEFPLALIAGTDAATGTKDASIDYHEWQASLALSYRLNMFTPYIGVKWSRASFDADTIRIAQPKSATAIFDTTTLNPTIAGAGDVKASAEGQLGDTMQIVSLQLNKMKSRKSCGIAVGTTIVDADKYAVTVETRLIDERAAHVNAQFRF

SEQ ID NO: 146 - protein, 412 aa, Artificial Sequence
  Synthetic Polypeptide
MGLQTTKWPSHGAFFLKSWLIISLGLYSQVSKLLALPVGNPAEPSLMIDGILWEGFGGDPCDPCTTWCDAISMRMGYYGDFVFDRVLKTDVNKEFQMGDKPTSTTGNATAPTTLTARENPAYGRHMQDAEMFTNAACMALNIWDRFDVFCTLGASSGYLKGNSASFNLVGLFGDNENQSTVKTNSVPNMSLDQSVVELYTDTAFSWSVGARAALWECGCATLGASFQYAQSKPKVEELNVLCNAAEFTINKPKGYVGQEFPLALIAGTDAATGTKDASIDYHEWQASLALSYRLNMFTPYIGVKWSRASFDADTIRIAQPKSATAIFDTTTLNPTIAGAGDVKASAEGQLGDTMQIVSLQLNKMKSRKSCGIAVGTTIVDADKYAVTVETRLIDERAAHVNAQFRFHHHHHH

SEQ ID NO: 147 - protein, 391 aa, Artificial Sequence
  Synthetic Polypeptide
METPAQLLFLLLLWLPDTTGLPVGNPAEPSLMIDGILWEGFGGDPCDPCTTWCDAISMRMGYYGDFVFDRVLKTDVNKEFQMGDKPTSTTGNATAPTTLTARENPAYGRHMQDAEMFTNAACMALNIWDRFDVFCTLGASSGYLKGNSASFNLVGLFGDNENQSTVKTNSVPNMSLDQSVVELYTDTAFSWSVGARAALWECGCATLGASFQYAQSKPKVEELNVLCNAAEFTINKPKGYVGQEFPLALIAGTDAATGTKDASIDYHEWQASLALSYRLNMFTPYIGVKWSRASFDADTIRIAQPKSATAIFDTTTLNPTIAGAGDVKASAEGQLGDTMQIVSLQLNKMKSRKSCGIAVGTTIVDADKYAVTVETRLIDERAAHVNAQFRF

SEQ ID NO: 148 - protein, 397 aa, Artificial Sequence
  Synthetic Polypeptide
METPAQLLFLLLLWLPDTTGLPVGNPAEPSLMIDGILWEGFGGDPCDPCTTWCDAISMRMGYYGDFVFDRVLKTDVNKEFQMGDKPTSTTGNATAPTTLTARENPAYGRHMQDAEMFTNAACMALNIWDRFDVFCTLGASSGYLKGNSASFNLVGLFGDNENQSTVKTNSVPNMSLDQSVVELYTDTAFSWSVGARAALWECGCATLGASFQYAQSKPKVEELNVLCNAAEFTINKPKGYVGQEFPLALIAGTDAATGTKDASIDYHEWQASLALSYRLNMFTPYIGVKWSRASFDADTIRIAQPKSATAIFDTTTLNPTIAGAGDVKASAEGQLGDTMQIVSLQLNKMKSRKSCGIAVGTTIVDADKYAVTVETRLIDERAAHVNAQFRFHHHHHH

SEQ ID NO: 149 - protein, 392 aa, Artificial Sequence
  Synthetic Polypeptide
MWWRLWWLLLLLLLLWPMVWALPVGNPAEPSLMIDGILWEGFGGDPCDPCTTWCDAISMRMGYYGDFVFDRVLKTDVNKEFQMGDKPTSTTGNATAPTTLTARENPAYGRHMQDAEMFTNAACMALNIWDRFDVFCTLGASSGYLKGNSASFNLVGLFGDNENQSTVKTNSVPNMSLDQSVVELYTDTAFSWSVGARAALWECGCATLGASFQYAQSKPKVEELNVLCNAAEFTINKPKGYVGQEFPLALIAGTDAATGTKDASIDYHEWQASLALSYRLNMFTPYIGVKWSRASFDADTIRIAQPKSATAIFDTTTLNPTIAGAGDVKASAEGQLGDTMQIVSLQLNKMKSRKSCGIAVGTTIVDADKYAVTVETRLIDERAAHVNAQFRF

SEQ ID NO: 150 - protein, 398 aa, Artificial Sequence
  Synthetic Polypeptide
MWWRLWWLLLLLLLLWPMVWALPVGNPAEPSLMIDGILWEGFGGDPCDPCTTWCDAISMRMGYYGDFVFDRVLKTDVNKEFQMGDKPTSTTGNATAPTTLTARENPAYGRHMQDAEMFTNAACMALNIWDRFDVFCTLGASSGYLKGNSASFNLVGLFGDNENQSTVKTNSVPNMSLDQSVVELYTDTAFSWSVGARAALWECGCATLGASFQYAQSKPKVEELNVLCNAAEFTINKPKGYVGQEFPLALIAGTDAATGTKDASIDYHEWQASLALSYRLNMFTPYIGVKWSRASFDADTIRIAQPKSATAIFDTTTLNPTIAGAGDVKASAEGQLGDTMQIVSLQLNKMKSRKSCGIAVGTTIVDADKYAVTVETRLIDERAAHVNAQFRFHHHHHH

SEQ ID NO: 151 - protein, 601 aa, Artificial Sequence
  Synthetic Polypeptide
METPAQLLFLLLLWLPDTTGVRGESLVCKNALQDLSFLEHLLQVKYAPKTWKEQYLGWDLVQSSVSAQQKLRTQENPSTSFCQQVLADFIGGLNDFAAGVTFFAIESAYLPYTVQKSSDGRFYFVDIMTFSSEIRVGDELLEVDGAPVQDVLATLYGSNHKGTAAEESAALRTLFSRMASLGHKVPSGRTTLKIRRPFGTTREVRVKWRYVPEGVGDLATIAPSIRAPQLQKSMRSFFPKKDDAFHRSSSLFYSPMVPHFWAELRNHYATSGLKSGYNIGSTDGFLPVIGPVIWESEGLFRAYISSVTDGDGKSHKVGFLRIPTYSWQDMEDFDPSGPPPWEEFAKIIQVFSSNTEALIIDQTNNPGGSVLYLYALLSMLTDRPLELPKHRMILTQDEVVDALDWLTLLENVDTNVESRLALGDNMEGYTVDLQVAEYLKSFGRQVLNCWSKGDIELSTPIPLFGFEKIHPHPRVQYSKPICVLINEQDFSCADFFPVVLKDNDRALIVGTRTAGAGGFVFNVQFPNRTGIKTCSLTGSLAVREHGAFIENIGVEPHIDLPFTANDIRYKGYSEYLDKVKKLVCQLINNDGTIILAEDGSF

SEQ ID NO: 152 - protein, 607 aa, Artificial Sequence
  Synthetic Polypeptide
METPAQLLFLLLLWLPDTTGVRGESLVCKNALQDLSFLEHLLQVKYAPKTWKEQYLGWDLVQSSVSAQQKLRTQENPSTSFCQQVLADFIGGLNDFAAGVTFFAIESAYLPYTVQKSSDGRFYFVDIMTFSSEIRVGDELLEVDGAPVQDVLATLYGSNHKGTAAEESAALRTLFSRMASLGHKVPSGRTTLKIRRPFGTTREVRVKWRYVPEGVGDLATIAPSIRAPQLQKSMRSFFPKKDDAFHRSSSLFYSPMVPHFWAELRNHYATSGLKSGYNIGSTDGFLPVIGPVIWESEGLFRAYISSVTDGDGKSHKVGFLRIPTYSWQDMEDFDPSGPPPWEEFAKIIQVFSSNTEALIIDQTNNPGGSVLYLYALLSMLTDRPLELPKHRMILTQDEVVDALDWLTLLENVDTNVESRLALGDNMEGYTVDLQVAEYLKSFGRQVLNCWSKGDIELSTPIPLFGFEKIHPHPRVQYSKPICVLINEQDFSCADFFPVVLKDNDRALIVGTRTAGAGGFVFNVQFPNRTGIKTCSLTGSLAVREHGAFIENIGVEPHIDLPFTANDIRYKGYSEYLDKVKKLVCQLINNDGTIILAEDGSFHHHHHH

SEQ ID NO: 153 - protein, 601 aa, Artificial Sequence
  Synthetic Polypeptide
METPAQLLFLLLLWLPDTTGVRGESLVCKNALQDLSFLEHLLQVKYAPKTWKEQYLGWDLVQSSVSAQQKLRTQENPSTSFCQQVLADFIGGLNDFHAGVTFFAIESAYLPYTVQKSSDGRFYFVDIMTFSSEIRVGDELLEVDGAPVQDVLATLYGSNHKGTAAEESAALRTLFSRMASLGHKVPSGRTTLKIRRPFGTTREVRVKWRYVPEGVGDLATIAPSIRAPQLQKSMRSFFPKKDDAFHRSSSLFYSPMVPHFWAELRNHYATSGLKSGYNIGSTDGFLPVIGPVIWESEGLFRAYISSVTDGDGKSHKVGFLRIPTYSWQDMEDFDPSGPPPWEEFAKIIQVFSSNTEALIIDQTNNPGGSVLYLYALLSMLTDRPLELPKHRMILTQDEVVDALDWLTLLENVDTNVESRLALGDNMEGYTVDLQVAEYLKSFGRQVLNCWSKGDIELSTPIPLFGFEKIHPHPRVQYSKPICVLINEQDFACADFFPVVLKDNDRALIVGTRTAGAGGFVFNVQFPNRTGIKTCSLTGSLAVREHGAFIENIGVEPHIDLPFTANDIRYKGYSEYLDKVKKLVCQLINNDGTIILAEDGSF

SEQ ID NO: 154 - protein, 607 aa, Artificial Sequence
  Synthetic Polypeptide
METPAQLLFLLLLWLPDTTGVRGESLVCKNALQDLSFLEHLLQVKYAPKTWKEQYLGWDLVQSSVSAQQKLRTQENPSTSFCQQVLADFIGGLNDFHAGVTFFAIESAYLPYTVQKSSDGRFYFVDIMTFSSEIRVGDELLEVDGAPVQDVLATLYGSNHKGTAAEESAALRTLFSRMASLGHKVPSGRTTLKIRRPFGTTREVRVKWRYVPEGVGDLATIAPSIRAPQLQKSMRSFFPKKDDAFHRSSSLFYSPMVPHFWAELRNHYATSGLKSGYNIGSTDGFLPVIGPVIWESEGLFRAYISSVTDGDGKSHKVGFLRIPTYSWQDMEDFDPSGPPPWEEFAKIIQVFSSNTEALIIDQTNNPGGSVLYLYALLSMLTDRPLELPKHRMILTQDEVVDALDWLTLLENVDTNVESRLALGDNMEGYTVDLQVAEYLKSFGRQVLNCWSKGDIELSTPIPLFGFEKIHPHPRVQYSKPICVLINEQDFACADFFPVVLKDNDRALIVGTRTAGAGGFVFNVQFPNRTGIKTCSLTGSLAVREHGAFIENIGVEPHIDLPFTANDIRYKGYSEYLDKVKKLVCQLINNDGTIILAEDGSFHHHHHH

SEQ ID NO: 155 - protein, 441 aa, Artificial Sequence
  Synthetic Polypeptide
METPAQLLFLLLLWLPDTTGMTASGGAGGLGSTQTVDVARAQAAAATQDAQEVIGSQEASEASMLKGCEDLINPAAATRIKKKEEKFESLEARRKPTADKAEKKSESTEEKGDTPLEDRFTEDLSEVSGEDFRGLKNSFDDDSSPEEILDALTSKFSDPTIKDLALDYLIQTAPSDRKLKSALIQAKHQLMSQNPQAIVGGRNVLLASETFASRANTSPSSLRSLYLQVTSSPSNCDNLRQMLASYLPSEKTAVMEFLVNGMVADLKSEGPSIPPAKLQVYMTELSNLQALHSVDSFFDRNIGNLENSLKHEGHAPIPSLTTGNLAKTFLQLVEDKFPSSSKAQKALNELVGPDTGPQTEVLNLFFRALNGCSPRIFSGAEKKQQLASVITNTLDAINADNEDYPKPGDFPRSSFSSTPPHAPVPQSEIPTSPTSTQPPSP

SEQ ID NO: 156 - protein, 447 aa, Artificial Sequence
  Synthetic Polypeptide
METPAQLLFLLLLWLPDTTGMTASGGAGGLGSTQTVDVARAQAAAATQDAQEVIGSQEASEASMLKGCEDLINPAAATRIKKKEEKFESLEARRKPTADKAEKKSESTEEKGDTPLEDRFTEDLSEVSGEDFRGLKNSFDDDSSPEEILDALTSKFSDPTIKDLALDYLIQTAPSDRKLKSALIQAKHQLMSQNPQAIVGGRNVLLASETFASRANTSPSSLRSLYLQVTSSPSNCDNLRQMLASYLPSEKTAVMEFLVNGMVADLKSEGPSIPPAKLQVYMTELSNLQALHSVDSFFDRNIGNLENSLKHEGHAPIPSLTTGNLAKTFLQLVEDKFPSSSKAQKALNELVGPDTGPQTEVLNLFFRALNGCSPRIFSGAEKKQQLASVITNTLDAINADNEDYPKPGDFPRSSFSSTPPHAPVPQSEIPTSPTSTQPPSPHHHHHH

SEQ ID NO: 157 - protein, 441 aa, Artificial Sequence
  Synthetic Polypeptide
METPAQLLFLLLLWLPDTTGMTASGGAGGLGSTQTVDVARAQAAAATQDAQEVIGSQEASEASMLKGCEDLINPAAATRIKKKEEKFESLEARRKPTADKAEKKSESTEEKGDTPLEDRFTEDLSEVSGEDFRGLKNSFDDDSSPEEILDALTSKFSDPTIKDLALDYLIQTAPSDRKLKSALIQAKHQLMSQNPQAIVGGRNVLLASETFASRANTAPSSLRSLYLQVTSSPSNCDNLRQMLASYLPSEKTAVMEFLVNGMVADLKSEGPSIPPAKLQVYMTELSNLQALHSVDSFFDRNIGNLENSLKHEGHAPIPSLTTGNLAKTFLQLVEDKFPSSSKAQKALNELVGPDTGPQTEVLNLFFRALNGCSPRIFSGAEKKQQLASVITNTLDAINADNEDYPKPGDFPRSSFSSTPPHAPVPQSEIPTSPTSTQPPSP

SEQ ID NO: 158 - protein, 447 aa, Artificial Sequence
  Synthetic Polypeptide
METPAQLLFLLLLWLPDTTGMTASGGAGGLGSTQTVDVARAQAAAATQDAQEVIGSQEASEASMLKGCEDLINPAAATRIKKKEEKFESLEARRKPTADKAEKKSESTEEKGDTPLEDRFTEDLSEVSGEDFRGLKNSFDDDSSPEEILDALTSKFSDPTIKDLALDYLIQTAPSDRKLKSALIQAKHQLMSQNPQAIVGGRNVLLASETFASRANTAPSSLRSLYLQVTSSPSNCDNLRQMLASYLPSEKTAVMEFLVNGMVADLKSEGPSIPPAKLQVYMTELSNLQALHSVDSFFDRNIGNLENSLKHEGHAPIPSLTTGNLAKTFLQLVEDKFPSSSKAQKALNELVGPDTGPQTEVLNLFFRALNGCSPRIFSGAEKKQQLASVITNTLDAINADNEDYPKPGDFPRSSFSSTPPHAPVPQSEIPTSPTSTQPPSPHHHHHH

SEQ ID NO: 159 - protein, 441 aa, Artificial Sequence
  Synthetic Polypeptide
METPAQLLFLLLLWLPDTTGMTASGGAGGLGSTQTVDVARAQAAAATQDAQEVIGSQEASEASMLKGCEDLINPAAATRIKKKEEKFESLEARRKPTADKAEKKSESTEEKGDTPLEDRFTEDLSEVSGEDFRGLKNSFDDDSSPEEILDALTSKFSDPTIKDLALDYLIQTAPSDRKLKSALIQAKHQLMSQNPQAIVGGRNVLLASETFASRANTAPSSLRSLYLQVTSSPSNCDNLRQMLASYLPSEKTAVMEFLVNGMVADLKSEGPSIPPAKLQVYMTELSNLQALHSVDSFFDRNIGNLENSLKHEGHAPIPSLTTGNLTKTFLQLVEDKFPSSSKAQKALNELVGPDTGPQTEVLNLFFRALNGCSPRIFSGAEKKQQLASVITNTLDAINADNEDYPKPGDFPRSSFSSTPPHAPVPQSEIPTSPTSTQPPSP

SEQ ID NO: 160 - protein, 447 aa, Artificial Sequence
  Synthetic Polypeptide
METPAQLLFLLLLWLPDTTGMTASGGAGGLGSTQTVDVARAQAAAATQDAQEVIGSQEASEASMLKGCEDLINPAAATRIKKKEEKFESLEARRKPTADKAEKKSESTEEKGDTPLEDRFTEDLSEVSGEDFRGLKNSFDDDSSPEEILDALTSKFSDPTIKDLALDYLIQTAPSDRKLKSALIQAKHQLMSQNPQAIVGGRNVLLASETFASRANTAPSSLRSLYLQVTSSPSNCDNLRQMLASYLPSEKTAVMEFLVNGMVADLKSEGPSIPPAKLQVYMTELSNLQALHSVDSFFDRNIGNLENSLKHEGHAPIPSLTTGNLTKTFLQLVEDKFPSSSKAQKALNELVGPDTGPQTEVLNLFFRALNGCSPRIFSGAEKKQQLASVITNTLDAINADNEDYPKPGDFPRSSFSSTPPHAPVPQSEIPTSPTSTQPPSPHHHHHH

SEQ ID NO: 161 - protein, 617 aa, Artificial Sequence; identical to SEQ ID NO: 135
  Synthetic Polypeptide

SEQ ID NO: 162 - protein, 393 aa, Artificial Sequence; identical to SEQ ID NO: 68
  Synthetic Polypeptide

SEQ ID NO: 163 - protein, 690 aa, Artificial Sequence
  Synthetic Polypeptide
METPAQLLFLLLLWLPDTTGAEIMIPQGIYDGETLTVSFPYTVIGDPSGTTVFSAGELTLKNLDNSIAALPLSCFGNLLGSFTVLGRGHSLTFENIRTSTNGAALSDSANSGLFTIEGFKELSFSNCNSLLAVLPAATTNNGSQTPTTTSTPSNGTIYSKTDLLLLNNEKFSFYSNLVSGDGGAIDAKSLTVQGISKLCVFQENTAQADGGACQVVTSFSAMANEAPIAFIANVAGVRGGGIAAVQDGQQGVSSSTSTEDPVVSFSRNTAVEFDGNVARVGGGIYSYGNVAFLNNGKTLFLNNVASPVYIAAEQPTNGQASNTSDNYGDGGAIFCKNGAQAAGSNNSGSVSFDGEGVVFFSSNVAAGKGGAIYAKKLSVANCGPVQFLGNIANDGGAIYLGESGELSLSADYGDIIFDGNLKRTAKENAADVNGVTVSSQAISMGSGGKITTLRAKAGHQILFNDPIEMANGNNQPAQSSEPLKINDGEGYTGDIVFANGNSTLYQNVTIEQGRIVLREKAKLSVNSLSQTGGSLYMEAGSTLDFVTPQPPQQPPAANQLITLSNLHLSLSSLLANNAVTNPPTNPPAQDSHPAIIGSTTAGSVTISGPIFFEDLDDTAYDRYDWLGSNQKIDVLKLQLGTQPSANAPSDLTLGNEMPKYGYQGSWKLAWDPNTANNGPYTLKATWTKTG

SEQ ID NO: 164 - protein, 696 aa, Artificial Sequence
  Synthetic Polypeptide
METPAQLLFLLLLWLPDTTGAEIMIPQGIYDGETLTVSFPYTVIGDPSGTTVFSAGELTLKNLDNSIAALPLSCFGNLLGSFTVLGRGHSLTFENIRTSTNGAALSDSANSGLFTIEGFKELSFSNCNSLLAVLPAATTNNGSQTPTTTSTPSNGTIYSKTDLLLLNNEKFSFYSNLVSGDGGAIDAKSLTVQGISKLCVFQENTAQADGGACQVVTSFSAMANEAPIAFIANVAGVRGGGIAAVQDGQQGVSSSTSTEDPVVSFSRNTAVEFDGNVARVGGGIYSYGNVAFLNNGKTLFLNNVASPVYIAAEQPTNGQASNTSDNYGDGGAIFCKNGAQAAGSNNSGSVSFDGEGVVFFSSNVAAGKGGAIYAKKLSVANCGPVQFLGNIANDGGAIYLGESGELSLSADYGDIIFDGNLKRTAKENAADVNGVTVSSQAISMGSGGKITTLRAKAGHQILFNDPIEMANGNNQPAQSSEPLKINDGEGYTGDIVFANGNSTLYQNVTIEQGRIVLREKAKLSVNSLSQTGGSLYMEAGSTLDFVTPQPPQQPPAANQLITLSNLHLSLSSLLANNAVTNPPTNPPAQDSHPAIIGSTTAGSVTISGPIFFEDLDDTAYDRYDWLGSNQKIDVLKLQLGTQPSANAPSDLTLGNEMPKYGYQGSWKLAWDPNTANNGPYTLKATWTKTGHHHHHH

SEQ ID NO: 165 - protein, 689 aa, Artificial Sequence
  Synthetic Polypeptide
METPAQLLFLLLLWLPDTTGAEIMIPQGIYDGETLTVSFPYTVIGDPSGTTVFSAGELTLKNLDNSIAALPLSCFGNLLGSFTVLGRGHSLTFENIRTSTNGAALSNSAADGLFTIEGFKELSFSNCNSLLAVLPAATTNKGSQTPTTTSTPSNGTIYSKTDLLLLNNEKFSFYSNLVSGDGGAIDAKSLTVQGISKLCVFQENTAQADGGACQVVTSFSAMANEAPIAFVANVAGVRGGGIAAVQDGQQGVSSSTSTEDPVVSFSRNTAVEFDGNVARVGGGIYSYGNVAFLNNGKTLFLNNVASPVYIAAKQPTSGQASNTSNNYGDGGAIFCKNGAQAGSNNSGSVSFDGEGVVFFSSNVAAGKGGAIYAKKLSVANCGPVQFLRNIANDGGAIYLGESGELSLSADYGDIIFDGNLKRTAKENAADVNGVTVSSQAISMGSGGKITTLRAKAGHQILFNDPIEMANGNNQPAQSSKLLKINDGEGYTGDIVFANGSSTLYQNVTIEQGRIVLREKAKLSVNSLSQTGGSLYMEAGSTLDFVTPQPPQQPPAANQLITLSNLHLSLSSLLANNAVTNPPTNPPAQDSHPAVIGSTTAGSVTISGPIFFEDLDDTAYDRYDWLGSNQKINVLKLQLGTKPPANAPSDLTLGNEMPKYGYQGSWKLAWDPNTANNGPYTLKATWTKTG

SEQ ID NO: 166 - protein, 695 aa, Artificial Sequence
  Synthetic Polypeptide
METPAQLLFLLLLWLPDTTGAEIMIPQGIYDGETLTVSFPYTVIGDPSGTTVFSAGELTLKNLDNSIAALPLSCFGNLLGSFTVLGRGHSLTFENIRTSTNGAALSNSAADGLFTIEGFKELSFSNCNSLLAVLPAATTNKGSQTPTTTSTPSNGTIYSKTDLLLLNNEKFSFYSNLVSGDGGAIDAKSLTVQGISKLCVFQENTAQADGGACQVVTSFSAMANEAPIAFVANVAGVRGGGIAAVQDGQQGVSSSTSTEDPVVSFSRNTAVEFDGNVARVGGGIYSYGNVAFLNNGKTLFLNNVASPVYIAAKQPTSGQASNTSNNYGDGGAIFCKNGAQAGSNNSGSVSFDGEGVVFFSSNVAAGKGGAIYAKKLSVANCGPVQFLRNIANDGGAIYLGESGELSLSADYGDIIFDGNLKRTAKENAADVNGVTVSSQAISMGSGGKITTLRAKAGHQILFNDPIEMANGNNQPAQSSKLLKINDGEGYTGDIVFANGSSTLYQNVTIEQGRIVLREKAKLSVNSLSQTGGSLYMEAGSTLDFVTPQPPQQPPAANQLITLSNLHLSLSSLLANNAVTNPPTNPPAQDSHPAVIGSTTAGSVTISGPIFFEDLDDTAYDRYDWLGSNQKINVLKLQLGTKPPANAPSDLTLGNEMPKYGYQGSWKLAWDPNTANNGPYTLKATWTKTGHHHHHH

SEQ ID NO: 167 - protein, 1193 aa, Artificial Sequence; identical to SEQ ID NO: 114
  Synthetic Polypeptide

SEQ ID NO: 168 - protein, 1199 aa, Artificial Sequence; identical to SEQ ID NO: 113
  Synthetic Polypeptide

SEQ ID NO: 169 - protein, 1192 aa, Artificial Sequence
  Synthetic Polypeptide
METPAQLLFLLLLWLPDTTGSCVDLHAGGQSVNELVYVGPQAVLLLDQIRDLFVGSKDSQAEGQYRLIVGDPSSFQEKDADTLPGKVEQSTLFSVTNPVVFQGVDQQDQVSSQGLICSFTSSNLDSPRDGESFLGIAFVGDSSKAGITLTDVKASLSGAALYSTEDLIFEKIKGGLEFASCSSLEQGGACAAQSILIHDCQGLQVKHCTTAVNAEGSSANDHLGFGGGAFFVTGSLSGEKSLYMPAGDMVVANCDGAISFEGNSANFANGGAIAASGKVLFVANDKKTSFIENRALSGGAIAASSDIAFQNCAELVFKGNCAIGTEDKGSLGGGAISSLGTVLLQGNHGITCDKNESASQGGAIFGKNCQISDNEGPVVFRDSTACLGGGAIAAQEIVSIQNNQAGISFEGGKASFGGGIACGSFSSAGGASVLGTIDISKNLGAISFSRTLCTTSDLGQMEYQGGGALFGENISLSENAGVLTFKDNIVKTFASNGKILGGGAILATGKVEITNNSGGISFTGNARAPQALPTQEEFPLFSKKEGRPLSSGYSGGGAILGREVAILHNAAVVFEQNRLQCSEEEATLLGCCGGGAVHGMDSTSIVGNSSVRFGNNYAMGQGVSGGALLSKTVQLAGNGSVDFSRNIASLGGGALQASEGNCELVDNGYVLFRDNRGRVYGGAISCLRGDVVISGNKGRVEFKDNIATRLYVEETVEKVEEVEPAPEQKDNNELSFLGSVEQSFITAANQALFASEDGDLSPESSISSEELAKRRECAGGAIFAKRVRIVDNQEAVVFSNNFSDIYGGAIFTGSLREEDKLDGQIPEVLISGNAGDVVFSGNSSKRDEHLPHTGGGAICTQNLTISQNTGNVLFYNNVACSGGAVRIEDHGNVLLEAFGGDIVFKGNSSFRAQGSDAIYFAGKESHITALNATEGHAIVFHDALVFENLKERKSAEVLLINSRENPGYTGSIRFLEAESKVPQCIHVQQGSLELLNGATLCSYGFKQDAGAKLVLAAGSKLKILDSGTPVQGHAISKPEAEIESSSEPEGAHSLWIAKNAQTTVPMVDIHTISVDLASFSSSQQEGTVEAPQVIVPGGSYVRSGELNLELVNTTGTGYENHALLKNEAKVPLMSFVASSDEASAEISNLSVSDLQIHVATPEIEEDTYGHMGDWSEAKIQDGTLVISWNPTG

SEQ ID NO: 170 - protein, 1198 aa, Artificial Sequence
  Synthetic Polypeptide
METPAQLLFLLLLWLPDTTGSCVDLHAGGQSVNELVYVGPQAVLLLDQIRDLFVGSKDSQAEGQYRLIVGDPSSFQEKDADTLPGKVEQSTLFSVTNPVVFQGVDQQDQVSSQGLICSFTSSNLDSPRDGESFLGIAFVGDSSKAGITLTDVKASLSGAALYSTEDLIFEKIKGGLEFASCSSLEQGGACAAQSILIHDCQGLQVKHCTTAVNAEGSSANDHLGFGGGAFFVTGSLSGEKSLYMPAGDMVVANCDGAISFEGNSANFANGGAIAASGKVLFVANDKKTSFIENRALSGGAIAASSDIAFQNCAELVFKGNCAIGTEDKGSLGGGAISSLGTVLLQGNHGITCDKNESASQGGAIFGKNCQISDNEGPVVFRDSTACLGGGAIAAQEIVSIQNNQAGISFEGGKASFGGGIACGSFSSAGGASVLGTIDISKNLGAISFSRTLCTTSDLGQMEYQGGGALFGENISLSENAGVLTFKDNIVKTFASNGKILGGGAILATGKVEITNNSGGISFTGNARAPQALPTQEEFPLFSKKEGRPLSSGYSGGGAILGREVAILHNAAVVFEQNRLQCSEEEATLLGCCGGGAVHGMDSTSIVGNSSVRFGNNYAMGQGVSGGALLSKTVQLAGNGSVDFSRNIASLGGGALQASEGNCELVDNGYVLFRDNRGRVYGGAISCLRGDVVISGNKGRVEFKDNIATRLYVEETVEKVEEVEPAPEQKDNNELSFLGSVEQSFITAANQALFASEDGDLSPESSISSEELAKRRECAGGAIFAKRVRIVDNQEAVVFSNNFSDIYGGAIFTGSLREEDKLDGQIPEVLISGNAGDVVFSGNSSKRDEHLPHTGGGAICTQNLTISQNTGNVLFYNNVACSGGAVRIEDHGNVLLEAFGGDIVFKGNSSFRAQGSDAIYFAGKESHITALNATEGHAIVFHDALVFENLKERKSAEVLLINSRENPGYTGSIRFLEAESKVPQCIHVQQGSLELLNGATLCSYGFKQDAGAKLVLAAGSKLKILDSGTPVQGHAISKPEAEIESSSEPEGAHSLWIAKNAQTTVPMVDIHTISVDLASFSSSQQEGTVEAPQVIVPGGSYVRSGELNLELVNTTGTGYENHALLKNEAKVPLMSFVASSDEASAEISNLSVSDLQIHVATPEIEEDTYGHMGDWSEAKIQDGTLVISWNPTGHHHHHH

SEQ ID NO: 171 - protein, 106 aa, Artificial Sequence
  Synthetic Polypeptide
METPAQLLFLLLLWLPDTTGMSQNKNSAFMQPVNVSADLAAIVGAGPMPRTEIIKKMWDYIKKNGLQDPTNKRNINPDDKLAKVFGTEKPIDMFQMTKMVSQHIIK

SEQ ID NO: 172 - protein, 112 aa, Artificial Sequence
  Synthetic Polypeptide
METPAQLLFLLLLWLPDTTGMSQNKNSAFMQPVNVSADLAAIVGAGPMPRTEIIKKMWDYIKKNGLQDPTNKRNINPDDKLAKVFGTEKPIDMFQMTKMVSQHIIKHHHHHH

SEQ ID NO: 173 - protein, 106 aa, Artificial Sequence
  Synthetic Polypeptide
METPAQLLFLLLLWLPDTTGMSQNKNSAFMQPVNVSADLAAIVGAGPMPRTEIIKKMWDYIKENSLQDPTNKRNINPDDKLAKVFGTEKPIDMFQMTKMVSQHIIK

SEQ ID NO: 174 - protein, 112 aa, Artificial Sequence
  Synthetic Polypeptide
METPAQLLFLLLLWLPDTTGMSQNKNSAFMQPVNVSADLAAIVGAGPMPRTEIIKKMWDYIKENSLQDPTNKRNINPDDKLAKVFGTEKPIDMFQMTKMVSQHIIKHHHHHH

SEQ ID NO: 175 - protein, 673 aa, Artificial Sequence
  Synthetic Polypeptide
METPAQLLFLLLLWLPDTTGMESGPESVSSNQSSMNPIINGQIASNSETKESTKASEASPSASSSVSSWSFLSSAKNALISLRDAILNKNSSPTDSLSQLEASTSTSTVTRVAAKDYDEAKSNFDTAKSGLENAKTLAEYETKMADLMAALQDMERLANSDPSNNHTEEVNNIKKALEAQKDTIDKLNKLVTLQNQNKSLTEVLKTTDSADQIPAINSQLEINKNSADQIIKDLERQNISYEAVLTNAGEVIKASSEAGIKLGQALQSIVDAGDQSQAAVLQAQQNNSPDNIAATKELIDAAETKVNELKQEHTGLTDSPLVKKAEEQISQAQKDIQEIKPSGSDIPIVGPSGSAASAGSAAGALKSSNNSGRISLLLDDVDNEMAAIALQGFRSMIEQFNVNNPATAKELQAMEAQLTAMSDQLVGADGELPAEIQAIKDALAQALKQPSADGLATAMGQVAFAAAKVGGGSAGTAGTVQMNVKQLYKTAFSSTSSSSYAAALSDGYSAYKTLNSLYSESRSGVQSAISQTANPALSRSVSRSGIESQGRSADASQRAAETIVRDSQTLGDVYSRLQVLDSLMSTIVSNPQANQEEIMQKLTASISKAPQFGYPAVQNSADSLQKFAAQLEREFVDGERSLAESQENAFRKQPAFIQQVLVNIASLFSGYLS

SEQ ID NO: 176 - protein, 679 aa, Artificial Sequence
  Synthetic Polypeptide
METPAQLLFLLLLWLPDTTGMESGPESVSSNQSSMNPIINGQIASNSETKESTKASEASPSASSSVSSWSFLSSAKNALISLRDAILNKNSSPTDSLSQLEASTSTSTVTRVAAKDYDEAKSNFDTAKSGLENAKTLAEYETKMADLMAALQDMERLANSDPSNNHTEEVNNIKKALEAQKDTIDKLNKLVTLQNQNKSLTEVLKTTDSADQIPAINSQLEINKNSADQIIKDLERQNISYEAVLTNAGEVIKASSEAGIKLGQALQSIVDAGDQSQAAVLQAQQNNSPDNIAATKELIDAAETKVNELKQEHTGLTDSPLVKKAEEQISQAQKDIQEIKPSGSDIPIVGPSGSAASAGSAAGALKSSNNSGRISLLLDDVDNEMAAIALQGFRSMIEQFNVNNPATAKELQAMEAQLTAMSDQLVGADGELPAEIQAIKDALAQALKQPSADGLATAMGQVAFAAAKVGGGSAGTAGTVQMNVKQLYKTAFSSTSSSSYAAALSDGYSAYKTLNSLYSESRSGVQSAISQTANPALSRSVSRSGIESQGRSADASQRAAETIVRDSQTLGDVYSRLQVLDSLMSTIVSNPQANQEEIMQKLTASISKAPQFGYPAVQNSADSLQKFAAQLEREFVDGERSLAESQENAFRKQPAFIQQVLVNIASLFSGYLSHHHHHH

SEQ ID NO: 177 - protein, 601 aa, Artificial Sequence
  Synthetic Polypeptide
METPAQLLFLLLLWLPDTTGVRGESLVCKNALQDLSFLEHLLQVKYAPKTWKEQYLGWDLVQSSVSAQQKLRTQENPSTSFCQQVLADFIGGLNDFHAGVTFFAIESAYLPYTVQKSSDGRFYFVDIMTFSSEIRVGDELLEVDGAPVQDVLATLYGSNHKGTAAEESAALRTLFSRMASLGHKVPSGRTTLKIRRPFGTTREVRVKWRYVPEGVGDLATIAPSIRAPQLQKSMRSFFPKKDDAFHRSSSLFYSPMVPHFWAELRNHYATSGLKSGYNIGSTDGFLPVIGPVIWESEGLFRAYISSVTDGDGKSHKVGFLRIPTYSWQDMEDFDPSGPPPWEEFAKIIQVFSSNTEALIIDQTNNPGGSVLYLYALLSMLTDRPLELPKHRMILTQDEVVDALDWLTLLENVDTNVESRLALGDNMEGYTVDLQVAEYLKSFGRQVLNCWSKGDIELSTPIPLFGFEKIHPHPRVQYSKPICVLINEQDFSCADFFPVVLKDNDRALIVGTRTAGAGGFVFNVQFPNRTGIKTCSLTGSLAVREHGAFIENIGVEPHIDLPFTANDIRYKGYSEYLDKVKKLVCQLINNDGTIILAEDGSF

SEQ ID NO: 178 - protein, 607 aa, Artificial Sequence
  Synthetic Polypeptide
METPAQLLFLLLLWLPDTTGVRGESLVCKNALQDLSFLEHLLQVKYAPKTWKEQYLGWDLVQSSVSAQQKLRTQENPSTSFCQQVLADFIGGLNDFHAGVTFFAIESAYLPYTVQKSSDGRFYFVDIMTFSSEIRVGDELLEVDGAPVQDVLATLYGSNHKGTAAEESAALRTLFSRMASLGHKVPSGRTTLKIRRPFGTTREVRVKWRYVPEGVGDLATIAPSIRAPQLQKSMRSFFPKKDDAFHRSSSLFYSPMVPHFWAELRNHYATSGLKSGYNIGSTDGFLPVIGPVIWESEGLFRAYISSVTDGDGKSHKVGFLRIPTYSWQDMEDFDPSGPPPWEEFAKIIQVFSSNTEALIIDQTNNPGGSVLYLYALLSMLTDRPLELPKHRMILTQDEVVDALDWLTLLENVDTNVESRLALGDNMEGYTVDLQVAEYLKSFGRQVLNCWSKGDIELSTPIPLFGFEKIHPHPRVQYSKPICVLINEQDFSCADFFPVVLKDNDRALIVGTRTAGAGGFVFNVQFPNRTGIKTCSLTGSLAVREHGAFIENIGVEPHIDLPFTANDIRYKGYSEYLDKVKKLVCQLINNDGTIILAEDGSFHHHHHH

SEQ ID NO: 179 - protein, 611 aa, Artificial Sequence; identical to SEQ ID NO: 131
  Synthetic Polypeptide

SEQ ID NO: 180 - protein, 617 aa, Artificial Sequence; identical to SEQ ID NO: 135
  Synthetic Polypeptide

SEQ ID NO: 181 - protein, 441 aa, Artificial Sequence
  Synthetic Polypeptide
METPAQLLFLLLLWLPDTTGMTASGGAGGLGSTQTVDVARAQAAAATQDAQEVIGSQEASEASMLKGCEDLINPAAATRIKKKEEKFESLEARRKPTADKAEKKSESTEEKGDTPLEDRFTEDLSEVSGEDFRGLKNSFDDDSSPEEILDALTSKFSDPTIKDLALDYLIQTAPSDRKLKSALIQAKHQLMSQNPQAIVGGRNVLLASETFASRANTSPSSLRSLYLQVTSSPSNCDNLRQMLASYLPSEKTAVMEFLVNGMVADLKSEGPSIPPAKLQVYMTELSNLQALHSVDSFFDRNIGNLENSLKHEGHAPIPSLTTGNLTKTFLQLVEDKFPSSSKAQKALNELVGPDTGPQTEVLNLFFRALNGCSPRIFSGAEKKQQLASVITNTLDAINADNEDYPKPGDFPRSSFSSTPPHAPVPQSEIPTSPTSTQPPSP

SEQ ID NO: 182 - protein, 447 aa, Artificial Sequence
  Synthetic Polypeptide
METPAQLLFLLLLWLPDTTGMTASGGAGGLGSTQTVDVARAQAAAATQDAQEVIGSQEASEASMLKGCEDLINPAAATRIKKKEEKFESLEARRKPTADKAEKKSESTEEKGDTPLEDRFTEDLSEVSGEDFRGLKNSFDDDSSPEEILDALTSKFSDPTIKDLALDYLIQTAPSDRKLKSALIQAKHQLMSQNPQAIVGGRNVLLASETFASRANTSPSSLRSLYLQVTSSPSNCDNLRQMLASYLPSEKTAVMEFLVNGMVADLKSEGPSIPPAKLQVYMTELSNLQALHSVDSFFDRNIGNLENSLKHEGHAPIPSLTTGNLTKTFLQLVEDKFPSSSKAQKALNELVGPDTGPQTEVLNLFFRALNGCSPRIFSGAEKKQQLASVITNTLDAINADNEDYPKPGDFPRSSFSSTPPHAPVPQSEIPTSPTSTQPPSPHHHHHH

SEQ ID NO: 183 - protein, 391 aa, Artificial Sequence
  Synthetic Polypeptide
MKKLLKSAFLSAAFFAGHASLHALPVGNPAEPSLLIDGTIWEGMSGDPCDPCATWCDAISLRVGFYGDYVFDRVLKTDVPQKFSMGPIPTSSTSPEDSAILTERNNAAYGKHMHDAELFTNAGYIALNIWDRFDIFCTLGATSGYFKGNSSSFNLIGLIGISGADLNSKLPNANISNGVVELYTDTTFSWSVGARGALWECGCATLGAEFQYAQSKPRVQELNVLSNVAQFTVHKPRGYVGQPLPLPLTAGTATDSNDKLKNATINYHEWQVGAALSYRLNMLVPYIGVQWSRATFDADTIQIAEPKLASPIFNLTTWNPTLLGQATSVDSGNKFADSLQIVSLQINKLKSRKACGVSMGATLLDADKWAINGELRLINERAAHLSAQCRF

SEQ ID NO: 184 - DNA, 399 bp, Artificial Sequence
  Synthetic Polynucleotide
atggaaacccctgcccagctgctgttcctgctgctgctgtggctgcctgataccaccggccctcccctgcccagcagcacacaggacaacagatccatggaccagcaggacagcgaagagttcctgctgcagaacaccctggaagatagcgagatcatcagcatccccgacaccatgaaccagatcgccatcgacaccgagaagtggttctacctgaacaaggactgcaccaacgtgggccccatctccatcgtgcagctgacagccttcctgaaagagtgcaagcacagccccgagaagggcatcgacccccaggaactgtgggtgtggaagaaaggcatgcccaactgggagaaagtgaagaacatccccgagctgagcggcaccgtgaaggacgag

SEQ ID NO: 185 - DNA, 417 bp, Artificial Sequence
  Synthetic Polynucleotide
atggaaacccctgcccagctgctgttcctgctgctgctgtggctgcctgataccaccggccctcccctgcccagcagcacacaggacaacagatccatggaccagcaggacagcgaagagttcctgctgcagaacaccctggaagatagcgagatcatcagcatccccgacaccatgaaccagatcgccatcgacaccgagaagtggttctacctgaacaaggactgcaccaacgtgggccccatctccatcgtgcagctgacagccttcctgaaagagtgcaagcacagccccgagaagggcatcgacccccaggaactgtgggtgtggaagaaaggcatgcccaactgggagaaagtgaagaacatccccgagctgagcggcaccgtgaaggacgagcaccaccaccatcaccac

SEQ ID NO: 186 - DNA, 3183 bp, Artificial Sequence
  Synthetic Polynucleotide
atggaaacccctgctcagctgctgttcctgctgctgctgtggctgcctgatacaaccggcgagcctaagagctgcgacaagacccacacctgtcctccatgtcctgctccagaactgctcggcggaccttccgtgttcctgtttcctccaaagcctaaggacaccctgatgatcagcagaacccctgaagtgacctgcgtggtggtggatgtgtcccacgaggatcccgaagtgaagttcaattggtacgtggacggcgtggaagtgcacaacgccaagaccaagcctagagaggaacagtacaacagcacctacagagtggtgtccgtgctgaccgtgctgcaccaggattggctgaacggcaaagagtacaagtgcaaggtgtccaacaaggccctgcctgctcctatcgagaagaccatcagcaaggccaagggccagccaagagaaccccaggtgtacacactgcctccaagcagagatgagctgaccaagaaccaggtgtccctgacctgtctggtcaagggcttctacccctccgatatcgccgtggaatgggagagcaatggccagcctgagaacaactacaagacaacccctcctgtgctggacagcgacggctcattcttcctgtacagcaagctgacagtggacaagagcagatggcagcagggcaacgtgttcagctgcagcgtgatgcacgaggccctgcacaatcactacacccagaagtccctgtctctgagccccggcaagatgagcatcagaggcgtgggcggcaacggcaacagcagaatccctagccacaacggcgacggcagcaacaggcggagccagaacaccaagggcaacaacaaggtggaagatagagtgtgcagcctgtacagcagccggtccaacgagaaccgcgagagcccttatgccgtggtggacgtgtccagcatgatcgagagcacccccaccagcggcgagacaaccagagctagtagaggcgtgctgagccggttccagaggggcctcgtgcggattgctgacaaagtgcggagagccgtgcagtgcgcttggagcagcgtgtccacaagcagaagcagcgccacaagagccgccgagagcggcagctctagcagaacagctagaggcgccagcagcggctacagagagtacagcccttctgccgctcggggcctgcggctgatgttcaccgacttttggcggacccgggtgctgagacagacctctcctatggccggcgtgttcggcaacctggacgtgaacgaggccagactgatggccgcctacaccagcgagtgtgccgatcacctggaagccaaagagctggccggacctgacggcgtggcagccgctagagaaatcgccaagagatgggagaagagagtgcgggacctgcaggacaagggcgctgccagaaagctgctgaacgaccccctgggcagacggacccccaactaccagagcaagaaccccggcgagtacaccgtgggcaactccatgttctacgacggcccccaggtggccaacctgcagaatgtggataccggcttctggctggacatgcagcacctgagcgacgtggtgctgtccagagagatccagaccggcctgagagccagagccaccctggaagagtccatgcccatgctggaaaatctggaagagagattccggcggctgcaggaaacctgcgacgccgccagaaccgagatcgaggaaagcggctggacccgggaaagcgcctccagaatggaaggcgacgaagcccagggccccagcagagtgcagcaggcctttcagagcttcgtgaatgagtgcaacagcatcgagttcagcttcggctccttcggcgagcacgtgcgggtgctgtgtgccagagtgtcaagaggactggccgctgccggcgaggccatcagaagatgcttcagctgctgcaagggcagcacccacagatacgcccccagagatgacctgtctcctgagggcgcctctctggccgaaaccctggccagattcgccgacgacatgggcatcgaaagaggcgccgacggcacctacgacatccccctggtggacgattggagaaggggcgtgccatccatcgagggcgagggcagcgatagcatctacgagatcatgatgcccatctacgaagtgatgaacatggacctggaaacccggcggagcttcgccgtgcagcagggccattaccaggaccccagagccagcgactacgacctgcctagagcctccgattacgatctgcccagaagcccctaccccacccctccactgcctcccagataccagctgcagaacatggatgtggaagccggctttcgcgaggccgtgtacgcctcttttgtggccggcatgtacaactacgtcgtgacccagccccaggaacggatccccaatagccagcaggtggaaggcatcctgcgggacatgctgaccaacggcgaccagaccttccgggacctgatgaagcggtggaacagagaggtggaccgcgagatgagccctatcctcggctactggaagatcaaaggcctggtgcagcccaccagactgctgctggaatacctggaagagaagtacgaggaacacctgtacgagcgcgacgagggcgataagtggcggaacaagaagttcgagctgggcctcgagttccccaacctgccttactacatcgacggcgacgtgaagctgacccagagcatggccatcatccggtatatcgccgacaagcacaacatgctcggcggctgccctaaagagcgggccgagatttctatgctggaaggcgccgtgctggacatcagatacggcgtgtccagaatcgcctacagcaaggacttcgaaaccctgaaggtggacttcctgagcaagctgcccgagatgctgaagatgttcgaggaccggctgtgccacaagacctacctgaatggcgaccacgtgacacaccccgacttcatgctgtacgacgccctggatgtggtgctgtacatggaccccatgtgcctggacgcctttccaaagctcgtgtgcttcaagaagcggatcgaggccattcctcagatcgacaagtacctgaagtccagcaagtatatcgcttggcccctgcaaggctggcaggccacatttggaggcggagatcaccctcctaag

SEQ ID NO: 187 - DNA, 2547 bp, Artificial Sequence
  Synthetic Polynucleotide
atggaaacccctgctcagctgctgttcctgctgctgctgtggctgcctgatacaaccggcgagcctaagagctgcgacaagacccacacctgtcctccatgtcctgctccagaactgctcggcggaccttccgtgttcctgtttcctccaaagcctaaggacaccctgatgatcagcagaacccctgaagtgacctgcgtggtggtggatgtgtcccacgaggatcccgaagtgaagttcaattggtacgtggacggcgtggaagtgcacaacgccaagaccaagcctagagaggaacagtacaacagcacctacagagtggtgtccgtgctgaccgtgctgcaccaggattggctgaacggcaaagagtacaagtgcaaggtgtccaacaaggccctgcctgctcctatcgagaagaccatcagcaaggccaagggccagccaagagaaccccaggtgtacacactgcctccaagcagagatgagctgaccaagaaccaggtgtccctgacctgtctggtcaagggcttctacccctccgatatcgccgtggaatgggagagcaatggccagcctgagaacaactacaagacaacccctcctgtgctggacagcgacggctcattcttcctgtacagcaagctgacagtggacaagagcagatggcagcagggcaacgtgttcagctgcagcgtgatgcacgaggccctgcacaatcactacacccagaagtccctgtctctgagccccggcaagatgagcatcagaggcgtgggcggcaacggcaacagcagaatccctagccacaacggcgacggcagcaacaggcggagccagaacaccaagggcaacaacaaggtggaagatagagtgtgcagcctgtacagcagccggtccaacgagaaccgcgagagcccttatgccgtggtggacgtgtccagcatgatcgagagcacccccaccagcggcgagacaaccagagctagtagaggcgtgctgagccggttccagaggggcctcgtgcggattgctgacaaagtgcggagagccgtgcagtgcgcttggagcagcgtgtccacaagcagaagcagcgccacaagagccgccgagagcggcagctctagcagaacagctagaggcgccagcagcggctacagagagtacagcccttctgccgctcggggcctgcggctgatgttcaccgacttttggcggacccgggtgctgagacagacctctcctatggccggcgtgttcggcaacctggacgtgaacgaggccagactgatggccgcctacaccagcgagtgtgccgatcacctggaagccaaagagctggccggacctgacggcgtggcagccgctagagaaatcgccaagagatgggagaagagagtgcgggacctgcaggacaagggcgctgccagaaagctgctgaacgaccccctgggcagacggacccccaactaccagagcaagaaccccggcgagtacaccgtgggcaactccatgttctacgacggcccccaggtggccaacctgcagaatgtggataccggcttctggctggacatgagcaacctgagcgacgtggtgctgtccagagagatccagaccggcctgagagccagagccaccctggaagagtccatgcccatgctggaaaatctggaagagagattccggcggctgcaggaaacctgcgacgccgccagaaccgagatcgaggaaagcggctggacccgggaaagcgcctccagaatggaaggcgacgaagcccagggccccagcagagtgcagcaggcctttcagagcttcgtgaatgagtgcaacagcatcgagttcagcttcggctccttcggcgagcacgtgcgggtgctgtgtgccagagtgtcaagaggactggccgctgccggcgaggccatcagaagatgcttcagctgctgcaagggcagcacccacagatacgcccccagagatgacctgtctcctgagggcgcctctctggccgaaaccctggccagattcgccgacgacatgggcatcgaaagaggcgccgacggcacctacgacatccccctggtggacgattggagaaggggcgtgccatccatcgagggcgagggcagcgatagcatctacgagatcatgatgcccatctacgaagtgatgaacatggacctggaaacccggcggagcttcgccgtgcagcagggccattaccaggaccccagagccagcgactacgacctgcctagagcctccgattacgatctgcccagaagcccctaccccacccctccactgcctcccagataccagctgcagaacatggatgtggaagccggctttcgcgaggccgtgtacgcctcttttgtggccggcatgtacaactacgtcgtgacccagccccaggaacggatccccaatagccagcaggtggaaggcatcctgcgggacatgctgaccaacggcagccagaccttccgggacctgatgaagcggtggaacagagaggtggaccgcgagcaccaccatcaccaccac

SEQ ID NO: 188 - DNA, 2529 bp, Artificial Sequence
  Synthetic Polynucleotide
atggaaacccctgctcagctgctgttcctgctgctgctgtggctgcctgatacaaccggcgagcctaagagctgcgacaagacccacacctgtcctccatgtcctgctccagaactgctcggcggaccttccgtgttcctgtttcctccaaagcctaaggacaccctgatgatcagcagaacccctgaagtgacctgcgtggtggtggatgtgtcccacgaggatcccgaagtgaagttcaattggtacgtggacggcgtggaagtgcacaacgccaagaccaagcctagagaggaacagtacaacagcacctacagagtggtgtccgtgctgaccgtgctgcaccaggattggctgaacggcaaagagtacaagtgcaaggtgtccaacaaggccctgcctgctcctatcgagaagaccatcagcaaggccaagggccagccaagagaaccccaggtgtacacactgcctccaagcagagatgagctgaccaagaaccaggtgtccctgacctgtctggtcaagggcttctacccctccgatatcgccgtggaatgggagagcaatggccagcctgagaacaactacaagacaacccctcctgtgctggacagcgacggctcattcttcctgtacagcaagctgacagtggacaagagcagatggcagcagggcaacgtgttcagctgcagcgtgatgcacgaggccctgcacaatcactacacccagaagtccctgtctctgagccccggcaagatgagcatcagaggcgtgggcggcaacggcaacagcagaatccctagccacaacggcgacggcagcaacaggcggagccagaacaccaagggcaacaacaaggtggaagatagagtgtgcagcctgtacagcagccggtccaacgagaaccgcgagagcccttatgccgtggtggacgtgtccagcatgatcgagagcacccccaccagcggcgagacaaccagagctagtagaggcgtgctgagccggttccagaggggcctcgtgcggattgctgacaaagtgcggagagccgtgcagtgcgcttggagcagcgtgtccacaagcagaagcagcgccacaagagccgccgagagcggcagctctagcagaacagctagaggcgccagcagcggctacagagagtacagcccttctgccgctcggggcctgcggctgatgttcaccgacttttggcggacccgggtgctgagacagacctctcctatggccggcgtgttcggcaacctggacgtgaacgaggccagactgatggccgcctacaccagcgagtgtgccgatcacctggaagccaaagagctggccggacctgacggcgtggcagccgctagagaaatcgccaagagatgggagaagagagtgcgggacctgcaggacaagggcgctgccagaaagctgctgaacgaccccctgggcagacggacccccaactaccagagcaagaaccccggcgagtacaccgtgggcaactccatgttctacgacggcccccaggtggccaacctgcagaatgtggataccggcttctggctggacatgcagcacctgagcgacgtggtgctgtccagagagatccagaccggcctgagagccagagccaccctggaagagtccatgcccatgctggaaaatctggaagagagattccggcggctgcaggaaacctgcgacgccgccagaaccgagatcgaggaaagcggctggacccgggaaagcgcctccagaatggaaggcgacgaagcccagggccccagcagagtgcagcaggcctttcagagcttcgtgaatgagtgcaacagcatcgagttcagcttcggctccttcggcgagcacgtgcgggtgctgtgtgccagagtgtcaagaggactggccgctgccggcgaggccatcagaagatgcttcagctgctgcaagggcagcacccacagatacgcccccagagatgacctgtctcctgagggcgcctctctggccgaaaccctggccagattcgccgacgacatgggcatcgaaagaggcgccgacggcacctacgacatccccctggtggacgattggagaaggggcgtgccatccatcgagggcgagggcagcgatagcatctacgagatcatgatgcccatctacgaagtgatgaacatggacctggaaacccggcggagcttcgccgtgcagcagggccattaccaggaccccagagccagcgactacgacctgcctagagcctccgattacgatctgcccagaagcccctaccccacccctccactgcctcccagataccagctgcagaacatggatgtggaagccggctttcgcgaggccgtgtacgcctcttttgtggccggcatgtacaactacgtcgtgacccagccccaggaacggatccccaatagccagcaggtggaaggcatcctgcgggacatgctgaccaacggcgaccagaccttccgggacctgatgaagcggtggaacagagaggtggaccgcgag

SEQ ID NO: 189 - DNA, 2529 bp, Artificial Sequence
  Synthetic Polynucleotide
atggaaacccctgctcagctgctgttcctgctgctgctgtggctgcctgatacaaccggcgagcctaagagctgcgacaagacccacacctgtcctccatgtcctgctccagaactgctcggcggaccttccgtgttcctgtttcctccaaagcctaaggacaccctgatgatcagcagaacccctgaagtgacctgcgtggtggtggatgtgtcccacgaggatcccgaagtgaagttcaattggtacgtggacggcgtggaagtgcacaacgccaagaccaagcctagagaggaacagtacaacagcacctacagagtggtgtccgtgctgaccgtgctgcaccaggattggctgaacggcaaagagtacaagtgcaaggtgtccaacaaggccctgcctgctcctatcgagaagaccatcagcaaggccaagggccagccaagagaaccccaggtgtacacactgcctccaagcagagatgagctgaccaagaaccaggtgtccctgacctgtctggtcaagggcttctacccctccgatatcgccgtggaatgggagagcaatggccagcctgagaacaactacaagacaacccctcctgtgctggacagcgacggctcattcttcctgtacagcaagctgacagtggacaagagcagatggcagcagggcaacgtgttcagctgcagcgtgatgcacgaggccctgcacaatcactacacccagaagtccctgtctctgagccccggcaagatgagcatcagaggcgtgggcggcaacggcaacagcagaatccctagccacaacggcgacggcagcaacaggcggagccagaacaccaagggcaacaacaaggtggaagatagagtgtgcagcctgtacagcagccggtccaacgagaaccgcgagagcccttatgccgtggtggacgtgtccagcatgatcgagagcacccccaccagcggcgagacaaccagagctagtagaggcgtgctgagccggttccagaggggcctcgtgcggattgctgacaaagtgcggagagccgtgcagtgcgcttggagcagcgtgtccacaagcagaagcagcgccacaagagccgccgagagcggcagctctagcagaacagctagaggcgccagcagcggctacagagagtacagcccttctgccgctcggggcctgcggctgatgttcaccgacttttggcggacccgggtgctgagacagacctctcctatggccggcgtgttcggcaacctggacgtgaacgaggccagactgatggccgcctacaccagcgagtgtgccgatcacctggaagccaaagagctggccggacctgacggcgtggcagccgctagagaaatcgccaagagatgggagaagagagtgcgggacctgcaggacaagggcgctgccagaaagctgctgaacgaccccctgggcagacggacccccaactaccagagcaagaaccccggcgagtacaccgtgggcaactccatgttctacgacggcccccaggtggccaacctgcagaatgtggataccggcttctggctggacatgagcaacctgagcgacgtggtgctgtccagagagatccagaccggcctgagagccagagccaccctggaagagtccatgcccatgctggaaaatctggaagagagattccggcggctgcaggaaacctgcgacgccgccagaaccgagatcgaggaaagcggctggacccgggaaagcgcctccagaatggaaggcgacgaagcccagggccccagcagagtgcagcaggcctttcagagcttcgtgaatgagtgcaacagcatcgagttcagcttcggctccttcggcgagcacgtgcgggtgctgtgtgccagagtgtcaagaggactggccgctgccggcgaggccatcagaagatgcttcagctgctgcaagggcagcacccacagatacgcccccagagatgacctgtctcctgagggcgcctctctggccgaaaccctggccagattcgccgacgacatgggcatcgaaagaggcgccgacggcacctacgacatccccctggtggacgattggagaaggggcgtgccatccatcgagggcgagggcagcgatagcatctacgagatcatgatgcccatctacgaagtgatgaacatggacctggaaacccggcggagcttcgccgtgcagcagggccattaccaggaccccagagccagcgactacgacctgcctagagcctccgattacgatctgcccagaagcccctaccccacccctccactgcctcccagataccagctgcagaacatggatgtggaagccggctttcgcgaggccgtgtacgcctcttttgtggccggcatgtacaactacgtcgtgacccagccccaggaacggatccccaatagccagcaggtggaaggcatcctgcgggacatgctgaccaacggcagccagaccttccgggacctgatgaagcggtggaacagagaggtggaccgcgag

SEQ ID NO: 190 - DNA, 2505 bp, Artificial Sequence
  Synthetic Polynucleotide
atggaaacccctgcccagctgctgttcctgctgctgctgtggctgcctgacaccaccggcatgagccctatcctcggctactggaagatcaaaggcctggtgcagcccaccagactgctgctggaatacctggaagagaagtacgaggaacacctgtacgagcgcgacgagggcgataagtggcggaacaagaagttcgagctgggcctcgagttccccaacctgccttactacatcgacggcgacgtgaagctgacccagagcatggccatcatccggtatatcgccgacaagcacaacatgctcggcggctgccctaaagagcgggccgagatttctatgctggaaggcgccgtgctggacatcagatacggcgtgtccagaatcgcctacagcaaggacttcgaaaccctgaaggtggacttcctgagcaagctgcccgagatgctgaagatgttcgaggaccggctgtgccacaagacctacctgaatggcgaccacgtgacacaccccgacttcatgctgtacgacgccctggatgtggtgctgtacatggaccccatgtgcctggacgcctttccaaagctcgtgtgcttcaagaagcggatcgaggccattcctcagatcgacaagtacctgaagtccagcaagtatatcgcttggcccctgcaaggctggcaggccacatttggaggcggagatcaccctcctaagatgagcatcagaggcgtgggcggcaacggcaacagcagaatccctagccacaacggcgacggcagcaacaggcggagccagaacaccaagggcaacaacaaggtggaagatagagtgtgcagcctgtacagcagccggtccaacgagaaccgcgagagcccttatgccgtggtggacgtgtccagcatgatcgagagcacccccaccagcggcgagacaaccagagctagtagaggcgtgctgagccggttccagaggggcctcgtgcggattgctgacaaagtgcggagagccgtgcagtgcgcttggagcagcgtgtccacaagcagaagcagcgccacaagagccgccgagagcggcagctctagcagaacagctagaggcgccagcagcggctacagagagtacagcccttctgccgctcggggcctgcggctgatgttcaccgacttttggcggacccgggtgctgagacagacctctcctatggccggcgtgttcggcaacctggacgtgaacgaggccagactgatggccgcctacaccagcgagtgtgccgatcacctggaagccaaagagctggccggacctgacggcgtggcagccgctagagaaatcgccaagagatgggagaagagagtgcgggacctgcaggacaagggcgctgccagaaagctgctgaacgaccccctgggcagacggacccccaactaccagagcaagaaccccggcgagtacaccgtgggcaactccatgttctacgacggcccccaggtggccaacctgcagaatgtggataccggcttctggctggacatgcagcacctgagcgacgtggtgctgtccagagagatccagaccggcctgagagccagagccaccctggaagagtccatgcccatgctggaaaatctggaagagagattccggcggctgcaggaaacctgcgacgccgccagaaccgagatcgaggaaagcggctggacccgggaaagcgcctccagaatggaaggcgacgaagcccagggccccagcagagtgcagcaggcctttcagagcttcgtgaatgagtgcaacagcatcgagttcagcttcggctccttcggcgagcacgtgcgggtgctgtgtgccagagtgtcaagaggactggccgctgccggcgaggccatcagaagatgcttcagctgctgcaagggcagcacccacagatacgcccccagagatgacctgtctcctgagggcgcctctctggccgaaaccctggccagattcgccgacgacatgggcatcgaaagaggcgccgacggcacctacgacatccccctggtggacgattggagaaggggcgtgccatccatcgagggcgagggcagcgatagcatctacgagatcatgatgcccatctacgaagtgatgaacatggacctggaaacccggcggagcttcgccgtgcagcagggccattaccaggaccccagagccagcgactacgacctgcctagagcctccgattacgatctgcccagaagcccctaccccacccctccactgcctcccagataccagctgcagaacatggatgtggaagccggctttcgcgaggccgtgtacgcctcttttgtggccggcatgtacaactacgtcgtgacccagccccaggaacggatccccaatagccagcaggtggaaggcatcctgcgggacatgctgaccaacggcgaccagaccttccgggacctgatgaagcggtggaacagagaggtggaccgcgagcaccaccatcaccaccac

SEQ ID NO: 191 - DNA, 2505 bp, Artificial Sequence
  Synthetic Polynucleotide
atggaaacccctgcccagctgctgttcctgctgctgctgtggctgcctgacaccaccggcatgagccctatcctcggctactggaagatcaaaggcctggtgcagcccaccagactgctgctggaatacctggaagagaagtacgaggaacacctgtacgagcgcgacgagggcgataagtggcggaacaagaagttcgagctgggcctcgagttccccaacctgccttactacatcgacggcgacgtgaagctgacccagagcatggccatcatccggtatatcgccgacaagcacaacatgctcggcggctgccctaaagagcgggccgagatttctatgctggaaggcgccgtgctggacatcagatacggcgtgtccagaatcgcctacagcaaggacttcgaaaccctgaaggtggacttcctgagcaagctgcccgagatgctgaagatgttcgaggaccggctgtgccacaagacctacctgaatggcgaccacgtgacacaccccgacttcatgctgtacgacgccctggatgtggtgctgtacatggaccccatgtgcctggacgcctttccaaagctcgtgtgcttcaagaagcggatcgaggccattcctcagatcgacaagtacctgaagtccagcaagtatatcgcttggcccctgcaaggctggcaggccacatttggaggcggagatcaccctcctaagatgagcatcagaggcgtgggcggcaacggcaacagcagaatccctagccacaacggcgacggcagcaacaggcggagccagaacaccaagggcaacaacaaggtggaagatagagtgtgcagcctgtacagcagccggtccaacgagaaccgcgagagcccttatgccgtggtggacgtgtccagcatgatcgagagcacccccaccagcggcgagacaaccagagctagtagaggcgtgctgagccggttccagaggggcctcgtgcggattgctgacaaagtgcggagagccgtgcagtgcgcttggagcagcgtgtccacaagcagaagcagcgccacaagagccgccgagagcggcagctctagcagaacagctagaggcgccagcagcggctacagagagtacagcccttctgccgctcggggcctgcggctgatgttcaccgacttttggcggacccgggtgctgagacagacctctcctatggccggcgtgttcggcaacctggacgtgaacgaggccagactgatggccgcctacaccagcgagtgtgccgatcacctggaagccaaagagctggccggacctgacggcgtggcagccgctagagaaatcgccaagagatgggagaagagagtgcgggacctgcaggacaagggcgctgccagaaagctgctgaacgaccccctgggcagacggacccccaactaccagagcaagaaccccggcgagtacaccgtgggcaactccatgttctacgacggcccccaggtggccaacctgcagaatgtggataccggcttctggctggacatgagcaacctgagcgacgtggtgctgtccagagagatccagaccggcctgagagccagagccaccctggaagagtccatgcccatgctggaaaatctggaagagagattccggcggctgcaggaaacctgcgacgccgccagaaccgagatcgaggaaagcggctggacccgggaaagcgcctccagaatggaaggcgacgaagcccagggccccagcagagtgcagcaggcctttcagagcttcgtgaatgagtgcaacagcatcgagttcagcttcggctccttcggcgagcacgtgcgggtgctgtgtgccagagtgtcaagaggactggccgctgccggcgaggccatcagaagatgcttcagctgctgcaagggcagcacccacagatacgcccccagagatgacctgtctcctgagggcgcctctctggccgaaaccctggccagattcgccgacgacatgggcatcgaaagaggcgccgacggcacctacgacatccccctggtggacgattggagaaggggcgtgccatccatcgagggcgagggcagcgatagcatctacgagatcatgatgcccatctacgaagtgatgaacatggacctggaaacccggcggagcttcgccgtgcagcagggccattaccaggaccccagagccagcgactacgacctgcctagagcctccgattacgatctgcccagaagcccctaccccacccctccactgcctcccagataccagctgcagaacatggatgtggaagccggctttcgcgaggccgtgtacgcctcttttgtggccggcatgtacaactacgtcgtgacccagccccaggaacggatccccaatagccagcaggtggaaggcatcctgcgggacatgctgaccaacggcagccagaccttccgggacctgatgaagcggtggaacagagaggtggaccgcgagcaccaccatcaccaccac

SEQ ID NO: 192 - DNA, 2487 bp, Artificial Sequence
  Synthetic Polynucleotide
atggaaacccctgcccagctgctgttcctgctgctgctgtggctgcctgacaccaccggcatgagccctatcctcggctactggaagatcaaaggcctggtgcagcccaccagactgctgctggaatacctggaagagaagtacgaggaacacctgtacgagcgcgacgagggcgataagtggcggaacaagaagttcgagctgggcctcgagttccccaacctgccttactacatcgacggcgacgtgaagctgacccagagcatggccatcatccggtatatcgccgacaagcacaacatgctcggcggctgccctaaagagcgggccgagatttctatgctggaaggcgccgtgctggacatcagatacggcgtgtccagaatcgcctacagcaaggacttcgaaaccctgaaggtggacttcctgagcaagctgcccgagatgctgaagatgttcgaggaccggctgtgccacaagacctacctgaatggcgaccacgtgacacaccccgacttcatgctgtacgacgccctggatgtggtgctgtacatggaccccatgtgcctggacgcctttccaaagctcgtgtgcttcaagaagcggatcgaggccattcctcagatcgacaagtacctgaagtccagcaagtatatcgcttggcccctgcaaggctggcaggccacatttggaggcggagatcaccctcctaagatgagcatcagaggcgtgggcggcaacggcaacagcagaatccctagccacaacggcgacggcagcaacaggcggagccagaacaccaagggcaacaacaaggtggaagatagagtgtgcagcctgtacagcagccggtccaacgagaaccgcgagagcccttatgccgtggtggacgtgtccagcatgatcgagagcacccccaccagcggcgagacaaccagagctagtagaggcgtgctgagccggttccagaggggcctcgtgcggattgctgacaaagtgcggagagccgtgcagtgcgcttggagcagcgtgtccacaagcagaagcagcgccacaagagccgccgagagcggcagctctagcagaacagctagaggcgccagcagcggctacagagagtacagcccttctgccgctcggggcctgcggctgatgttcaccgacttttggcggacccgggtgctgagacagacctctcctatggccggcgtgttcggcaacctggacgtgaacgaggccagactgatggccgcctacaccagcgagtgtgccgatcacctggaagccaaagagctggccggacctgacggcgtggcagccgctagagaaatcgccaagagatgggagaagagagtgcgggacctgcaggacaagggcgctgccagaaagctgctgaacgaccccctgggcagacggacccccaactaccagagcaagaaccccggcgagtacaccgtgggcaactccatgttctacgacggcccccaggtggccaacctgcagaatgtggataccggcttctggctggacatgcagcacctgagcgacgtggtgctgtccagagagatccagaccggcctgagagccagagccaccctggaagagtccatgcccatgctggaaaatctggaagagagattccggcggctgcaggaaacctgcgacgccgccagaaccgagatcgaggaaagcggctggacccgggaaagcgcctccagaatggaaggcgacgaagcccagggccccagcagagtgcagcaggcctttcagagcttcgtgaatgagtgcaacagcatcgagttcagcttcggctccttcggcgagcacgtgcgggtgctgtgtgccagagtgtcaagaggactggccgctgccggcgaggccatcagaagatgcttcagctgctgcaagggcagcacccacagatacgcccccagagatgacctgtctcctgagggcgcctctctggccgaaaccctggccagattcgccgacgacatgggcatcgaaagaggcgccgacggcacctacgacatccccctggtggacgattggagaaggggcgtgccatccatcgagggcgagggcagcgatagcatctacgagatcatgatgcccatctacgaagtgatgaacatggacctggaaacccggcggagcttcgccgtgcagcagggccattaccaggaccccagagccagcgactacgacctgcctagagcctccgattacgatctgcccagaagcccctaccccacccctccactgcctcccagataccagctgcagaacatggatgtggaagccggctttcgcgaggccgtgtacgcctcttttgtggccggcatgtacaactacgtcgtgacccagccccaggaacggatccccaatagccagcaggtggaaggcatcctgcgggacatgctgaccaacggcgaccagaccttccgggacctgatgaagcggtggaacagagaggtggaccgcgag

SEQ ID NO: 193 - DNA, 2487 bp, Artificial Sequence
  Synthetic Polynucleotide
atggaaacccctgcccagctgctgttcctgctgctgctgtggctgcctgacaccaccggcatgagccctatcctcggctactggaagatcaaaggcctggtgcagcccaccagactgctgctggaatacctggaagagaagtacgaggaacacctgtacgagcgcgacgagggcgataagtggcggaacaagaagttcgagctgggcctcgagttccccaacctgccttactacatcgacggcgacgtgaagctgacccagagcatggccatcatccggtatatcgccgacaagcacaacatgctcggcggctgccctaaagagcgggccgagatttctatgctggaaggcgccgtgctggacatcagatacggcgtgtccagaatcgcctacagcaaggacttcgaaaccctgaaggtggacttcctgagcaagctgcccgagatgctgaagatgttcgaggaccggctgtgccacaagacctacctgaatggcgaccacgtgacacaccccgacttcatgctgtacgacgccctggatgtggtgctgtacatggaccccatgtgcctggacgcctttccaaagctcgtgtgcttcaagaagcggatcgaggccattcctcagatcgacaagtacctgaagtccagcaagtatatcgcttggcccctgcaaggctggcaggccacatttggaggcggagatcaccctcctaagatgagcatcagaggcgtgggcggcaacggcaacagcagaatccctagccacaacggcgacggcagcaacaggcggagccagaacaccaagggcaacaacaaggtggaagatagagtgtgcagcctgtacagcagccggtccaacgagaaccgcgagagcccttatgccgtggtggacgtgtccagcatgatcgagagcacccccaccagcggcgagacaaccagagctagtagaggcgtgctgagccggttccagaggggcctcgtgcggattgctgacaaagtgcggagagccgtgcagtgcgcttggagcagcgtgtccacaagcagaagcagcgccacaagagccgccgagagcggcagctctagcagaacagctagaggcgccagcagcggctacagagagtacagcccttctgccgctcggggcctgcggctgatgttcaccgacttttggcggacccgggtgctgagacagacctctcctatggccggcgtgttcggcaacctggacgtgaacgaggccagactgatggccgcctacaccagcgagtgtgccgatcacctggaagccaaagagctggccggacctgacggcgtggcagccgctagagaaatcgccaagagatgggagaagagagtgcgggacctgcaggacaagggcgctgccagaaagctgctgaacgaccccctgggcagacggacccccaactaccagagcaagaaccccggcgagtacaccgtgggcaactccatgttctacgacggcccccaggtggccaacctgcagaatgtggataccggcttctggctggacatgagcaacctgagcgacgtggtgctgtccagagagatccagaccggcctgagagccagagccaccctggaagagtccatgcccatgctggaaaatctggaagagagattccggcggctgcaggaaacctgcgacgccgccagaaccgagatcgaggaaagcggctggacccgggaaagcgcctccagaatggaaggcgacgaagcccagggccccagcagagtgcagcaggcctttcagagcttcgtgaatgagtgcaacagcatcgagttcagcttcggctccttcggcgagcacgtgcgggtgctgtgtgccagagtgtcaagaggactggccgctgccggcgaggccatcagaagatgcttcagctgctgcaagggcagcacccacagatacgcccccagagatgacctgtctcctgagggcgcctctctggccgaaaccctggccagattcgccgacgacatgggcatcgaaagaggcgccgacggcacctacgacatccccctggtggacgattggagaaggggcgtgccatccatcgagggcgagggcagcgatagcatctacgagatcatgatgcccatctacgaagtgatgaacatggacctggaaacccggcggagcttcgccgtgcagcagggccattaccaggaccccagagccagcgactacgacctgcctagagcctccgattacgatctgcccagaagcccctaccccacccctccactgcctcccagataccagctgcagaacatggatgtggaagccggctttcgcgaggccgtgtacgcctcttttgtggccggcatgtacaactacgtcgtgacccagccccaggaacggatccccaatagccagcaggtggaaggcatcctgcgggacatgctgaccaacggcagccagaccttccgggacctgatgaagcggtggaacagagaggtggaccgcgag

SEQ ID NO: 194 - DNA, 1800 bp, Artificial Sequence
  Synthetic Polynucleotide
atggaaacccctgcccagctgctgttcctgctgctgctgtggctgcctgacaccaccggcatgagcatcagaggcgtgggcggcaacggcaacagcagaatccctagccacaacggcgacggcagcaacaggcggagccagaacaccaagggcaacaacaaggtggaagatagagtgtgcagcctgtacagcagccggtccaacgagaaccgcgagagcccttatgccgtggtggacgtgtccagcatgatcgagagcacccccaccagcggcgagacaaccagagctagtagaggcgtgctgagccggttccagaggggcctcgtgcggattgctgacaaagtgcggagagccgtgcagtgcgcttggagcagcgtgtccacaagcagaagcagcgccacaagagccgccgagagcggcagctctagcagaacagctagaggcgccagcagcggctacagagagtacagcccttctgccgctcggggcctgcggctgatgttcaccgacttttggcggacccgggtgctgagacagacctctcctatggccggcgtgttcggcaacctggacgtgaacgaggccagactgatggccgcctacaccagcgagtgtgccgatcacctggaagccaaagagctggccggacctgacggcgtggcagccgctagagaaatcgccaagagatgggagaagagagtgcgggacctgcaggacaagggcgctgccagaaagctgctgaacgaccccctgggcagacggacccccaactaccagagcaagaaccccggcgagtacaccgtgggcaactccatgttctacgacggcccccaggtggccaacctgcagaatgtggataccggcttctggctggacatgcagcacctgagcgacgtggtgctgtccagagagatccagaccggcctgagagccagagccaccctggaagagtccatgcccatgctggaaaatctggaagagagattccggcggctgcaggaaacctgcgacgccgccagaaccgagatcgaggaaagcggctggacccgggaaagcgcctccagaatggaaggcgacgaagcccagggccccagcagagtgcagcaggcctttcagagcttcgtgaatgagtgcaacagcatcgagttcagcttcggctccttcggcgagcacgtgcgggtgctgtgtgccagagtgtcaagaggactggccgctgccggcgaggccatcagaagatgcttcagctgctgcaagggcagcacccacagatacgcccccagagatgacctgtctcctgagggcgcctctctggccgaaaccctggccagattcgccgacgacatgggcatcgaaagaggcgccgacggcacctacgacatccccctggtggacgattggagaaggggcgtgccatccatcgagggcgagggcagcgatagcatctacgagatcatgatgcccatctacgaagtgatgaacatggacctggaaacccggcggagcttcgccgtgcagcagggccattaccaggaccccagagccagcgactacgacctgcctagagcctccgattacgatctgcccagaagcccctaccccacccctccactgcctcccagataccagctgcagaacatggatgtggaagccggctttcgcgaggccgtgtacgcctcttttgtggccggcatgtacaactacgtcgtgacccagccccaggaacggatccccaatagccagcaggtggaaggcatcctgcgggacatgctgaccaacggcgaccaccaccatcaccaccac

SEQ ID NO: 195 - DNA, 1452 bp, Artificial Sequence
  Synthetic Polynucleotide
atggaaacccctgcccagctgctgttcctgctgctgctgtggctgcctgacaccaccggcatgagcatcagaggcgtgggcggcaacggcaacagcagaatccctagccacaacggcgacggcagcaacaggcggagccagaacaccaagggcaacaacaaggtggaagatagagtgtgcagcctgtacagcagccggtccaacgagaaccgcgagagcccttatgccgtggtggacgtgtccagcatgatcgagagcacccccaccagcggcgagacaaccagagctagtagaggcgtgctgagccggttccagaggggcctcgtgcggattgctgacaaagtgcggagagccgtgcagtgcgcttggagcagcgtgtccacaagcagaagcagcgccacaagagccgccgagagcggcagctctagcagaacagctagaggcgccagcagcggctacagagagtacagcccttctgccgctcggggcctgcggctgatgttcaccgacttttggcggacccgggtgctgagacagacctctcctatggccggcgtgttcggcaacctggacgtgaacgaggccagactgatggccgcctacaccagcgagtgtgccgatcacctggaagccaaagagctggccggacctgacggcgtggcagccgctagagaaatcgccaagagatgggagaagagagtgcgggacctgcaggacaagggcgctgccagaaagctgctgaacgaccccctgggcagacggacccccaactaccagagcaagaaccccggcgagtacaccgtgggcaactccatgttctacgacggcccccaggtggccaacctgcagaatgtggataccggcttctggctggacatgcagcacctgagcgacgtggtgctgtccagagagatccagaccggcctgagagccagagccaccctggaagagtccatgcccatgctggaaaatctggaagagagattccggcggctgcaggaaacctgcgacgccgccagaaccgagatcgaggaaagcggctggacccgggaaagcgcctccagaatggaaggcgacgaagcccagggccccagcagagtgcagcaggcctttcagagcttcgtgaatgagtgcaacagcatcgagttcagcttcggctccttcggcgagcacgtgcgggtgctgtgtgccagagtgtcaagaggactggccgctgccggcgaggccatcagaagatgcttcagctgctgcaagggcagcacccacagatacgcccccagagatgacctgtctcctgagggcgcctctctggccgaaaccctggccagattcgccgacgacatgggcatcgaaagaggcgccgacggcacctacgacatccccctggtggacgattggagaaggggcgtgccatccatcgagggcgagggcagccaccaccatcaccaccac

SEQ ID NO: 196 - DNA, 1800 bp, Artificial Sequence
  Synthetic Polynucleotide
atggaaacccctgcccagctgctgttcctgctgctgctgtggctgcctgacaccaccggcatgagcatcagaggcgtgggcggcaacggcaacagcagaatccctagccacaacggcgacggcagcaacaggcggagccagaacaccaagggcaacaacaaggtggaagatagagtgtgcagcctgtacagcagccggtccaacgagaaccgcgagagcccttatgccgtggtggacgtgtccagcatgatcgagagcacccccaccagcggcgagacaaccagagctagtagaggcgtgctgagccggttccagaggggcctcgtgcggattgctgacaaagtgcggagagccgtgcagtgcgcttggagcagcgtgtccacaagcagaagcagcgccacaagagccgccgagagcggcagctctagcagaacagctagaggcgccagcagcggctacagagagtacagcccttctgccgctcggggcctgcggctgatgttcaccgacttttggcggacccgggtgctgagacagacctctcctatggccggcgtgttcggcaacctggacgtgaacgaggccagactgatggccgcctacaccagcgagtgtgccgatcacctggaagccaaagagctggccggacctgacggcgtggcagccgctagagaaatcgccaagagatgggagaagagagtgcgggacctgcaggacaagggcgctgccagaaagctgctgaacgaccccctgggcagacggacccccaactaccagagcaagaaccccggcgagtacaccgtgggcaactccatgttctacgacggcccccaggtggccaacctgcagaatgtggataccggcttctggctggacatgagcaacctgagcgacgtggtgctgtccagagagatccagaccggcctgagagccagagccaccctggaagagtccatgcccatgctggaaaatctggaagagagattccggcggctgcaggaaacctgcgacgccgccagaaccgagatcgaggaaagcggctggacccgggaaagcgcctccagaatggaaggcgacgaagcccagggccccagcagagtgcagcaggcctttcagagcttcgtgaatgagtgcaacagcatcgagttcagcttcggctccttcggcgagcacgtgcgggtgctgtgtgccagagtgtcaagaggactggccgctgccggcgaggccatcagaagatgcttcagctgctgcaagggcagcacccacagatacgcccccagagatgacctgtctcctgagggcgcctctctggccgaaaccctggccagattcgccgacgacatgggcatcgaaagaggcgccgacggcacctacgacatccccctggtggacgattggagaaggggcgtgccatccatcgagggcgagggcagcgatagcatctacgagatcatgatgcccatctacgaagtgatgaacatggacctggaaacccggcggagcttcgccgtgcagcagggccattaccaggaccccagagccagcgactacgacctgcctagagcctccgattacgatctgcccagaagcccctaccccacccctccactgcctcccagataccagctgcagaacatggatgtggaagccggctttcgcgaggccgtgtacgcctcttttgtggccggcatgtacaactacgtcgtgacccagccccaggaacggatccccaatagccagcaggtggaaggcatcctgcgggacatgctgaccaacggcagccaccaccatcaccaccac

SEQ ID NO: 197 - DNA, 1452 bp, Artificial Sequence
  Synthetic Polynucleotide
atggaaacccctgcccagctgctgttcctgctgctgctgtggctgcctgacaccaccggcatgagcatcagaggcgtgggcggcaacggcaacagcagaatccctagccacaacggcgacggcagcaacaggcggagccagaacaccaagggcaacaacaaggtggaagatagagtgtgcagcctgtacagcagccggtccaacgagaaccgcgagagcccttatgccgtggtggacgtgtccagcatgatcgagagcacccccaccagcggcgagacaaccagagctagtagaggcgtgctgagccggttccagaggggcctcgtgcggattgctgacaaagtgcggagagccgtgcagtgcgcttggagcagcgtgtccacaagcagaagcagcgccacaagagccgccgagagcggcagctctagcagaacagctagaggcgccagcagcggctacagagagtacagcccttctgccgctcggggcctgcggctgatgttcaccgacttttggcggacccgggtgctgagacagacctctcctatggccggcgtgttcggcaacctggacgtgaacgaggccagactgatggccgcctacaccagcgagtgtgccgatcacctggaagccaaagagctggccggacctgacggcgtggcagccgctagagaaatcgccaagagatgggagaagagagtgcgggacctgcaggacaagggcgctgccagaaagctgctgaacgaccccctgggcagacggacccccaactaccagagcaagaaccccggcgagtacaccgtgggcaactccatgttctacgacggcccccaggtggccaacctgcagaatgtggataccggcttctggctggacatgagcaacctgagcgacgtggtgctgtccagagagatccagaccggcctgagagccagagccaccctggaagagtccatgcccatgctggaaaatctggaagagagattccggcggctgcaggaaacctgcgacgccgccagaaccgagatcgaggaaagcggctggacccgggaaagcgcctccagaatggaaggcgacgaagcccagggccccagcagagtgcagcaggcctttcagagcttcgtgaatgagtgcaacagcatcgagttcagcttcggctccttcggcgagcacgtgcgggtgctgtgtgccagagtgtcaagaggactggccgctgccggcgaggccatcagaagatgcttcagctgctgcaagggcagcacccacagatacgcccccagagatgacctgtctcctgagggcgcctctctggccgaaaccctggccagattcgccgacgacatgggcatcgaaagaggcgccgacggcacctacgacatccccctggtggacgattggagaaggggcgtgccatccatcgagggcgagggcagccaccaccatcaccaccac

SEQ ID NO: 198 - DNA, 1782 bp, Artificial Sequence
  Synthetic Polynucleotide
atggaaacccctgcccagctgctgttcctgctgctgctgtggctgcctgacaccaccggcatgagcatcagaggcgtgggcggcaacggcaacagcagaatccctagccacaacggcgacggcagcaacaggcggagccagaacaccaagggcaacaacaaggtggaagatagagtgtgcagcctgtacagcagccggtccaacgagaaccgcgagagcccttatgccgtggtggacgtgtccagcatgatcgagagcacccccaccagcggcgagacaaccagagctagtagaggcgtgctgagccggttccagaggggcctcgtgcggattgctgacaaagtgcggagagccgtgcagtgcgcttggagcagcgtgtccacaagcagaagcagcgccacaagagccgccgagagcggcagctctagcagaacagctagaggcgccagcagcggctacagagagtacagcccttctgccgctcggggcctgcggctgatgttcaccgacttttggcggacccgggtgctgagacagacctctcctatggccggcgtgttcggcaacctggacgtgaacgaggccagactgatggccgcctacaccagcgagtgtgccgatcacctggaagccaaagagctggccggacctgacggcgtggcagccgctagagaaatcgccaagagatgggagaagagagtgcgggacctgcaggacaagggcgctgccagaaagctgctgaacgaccccctgggcagacggacccccaactaccagagcaagaaccccggcgagtacaccgtgggcaactccatgttctacgacggcccccaggtggccaacctgcagaatgtggataccggcttctggctggacatgcagcacctgagcgacgtggtgctgtccagagagatccagaccggcctgagagccagagccaccctggaagagtccatgcccatgctggaaaatctggaagagagattccggcggctgcaggaaacctgcgacgccgccagaaccgagatcgaggaaagcggctggacccgggaaagcgcctccagaatggaaggcgacgaagcccagggccccagcagagtgcagcaggcctttcagagcttcgtgaatgagtgcaacagcatcgagttcagcttcggctccttcggcgagcacgtgcgggtgctgtgtgccagagtgtcaagaggactggccgctgccggcgaggccatcagaagatgcttcagctgctgcaagggcagcacccacagatacgcccccagagatgacctgtctcctgagggcgcctctctggccgaaaccctggccagattcgccgacgacatgggcatcgaaagaggcgccgacggcacctacgacatccccctggtggacgattggagaaggggcgtgccatccatcgagggcgagggcagcgatagcatctacgagatcatgatgcccatctacgaagtgatgaacatggacctggaaacccggcggagcttcgccgtgcagcagggccattaccaggaccccagagccagcgactacgacctgcctagagcctccgattacgatctgcccagaagcccctaccccacccctccactgcctcccagataccagctgcagaacatggatgtggaagccggctttcgcgaggccgtgtacgcctcttttgtggccggcatgtacaactacgtcgtgacccagccccaggaacggatccccaatagccagcaggtggaaggcatcctgcgggacatgctgaccaacggcgac

SEQ ID NO: 199 - DNA, 1434 bp, Artificial Sequence
  Synthetic Polynucleotide
atggaaacccctgcccagctgctgttcctgctgctgctgtggctgcctgacaccaccggcatgagcatcagaggcgtgggcggcaacggcaacagcagaatccctagccacaacggcgacggcagcaacaggcggagccagaacaccaagggcaacaacaaggtggaagatagagtgtgcagcctgtacagcagccggtccaacgagaaccgcgagagcccttatgccgtggtggacgtgtccagcatgatcgagagcacccccaccagcggcgagacaaccagagctagtagaggcgtgctgagccggttccagaggggcctcgtgcggattgctgacaaagtgcggagagccgtgcagtgcgcttggagcagcgtgtccacaagcagaagcagcgccacaagagccgccgagagcggcagctctagcagaacagctagaggcgccagcagcggctacagagagtacagcccttctgccgctcggggcctgcggctgatgttcaccgacttttggcggacccgggtgctgagacagacctctcctatggccggcgtgttcggcaacctggacgtgaacgaggccagactgatggccgcctacaccagcgagtgtgccgatcacctggaagccaaagagctggccggacctgacggcgtggcagccgctagagaaatcgccaagagatgggagaagagagtgcgggacctgcaggacaagggcgctgccagaaagctgctgaacgaccccctgggcagacggacccccaactaccagagcaagaaccccggcgagtacaccgtgggcaactccatgttctacgacggcccccaggtggccaacctgcagaatgtggataccggcttctggctggacatgcagcacctgagcgacgtggtgctgtccagagagatccagaccggcctgagagccagagccaccctggaagagtccatgcccatgctggaaaatctggaagagagattccggcggctgcaggaaacctgcgacgccgccagaaccgagatcgaggaaagcggctggacccgggaaagcgcctccagaatggaaggcgacgaagcccagggccccagcagagtgcagcaggcctttcagagcttcgtgaatgagtgcaacagcatcgagttcagcttcggctccttcggcgagcacgtgcgggtgctgtgtgccagagtgtcaagaggactggccgctgccggcgaggccatcagaagatgcttcagctgctgcaagggcagcacccacagatacgcccccagagatgacctgtctcctgagggcgcctctctggccgaaaccctggccagattcgccgacgacatgggcatcgaaagaggcgccgacggcacctacgacatccccctggtggacgattggagaaggggcgtgccatccatcgagggcgagggcagc

SEQ ID NO: 200 - DNA, 1782 bp, Artificial Sequence
  Synthetic Polynucleotide
atggaaacccctgcccagctgctgttcctgctgctgctgtggctgcctgacaccaccggcatgagcatcagaggcgtgggcggcaacggcaacagcagaatccctagccacaacggcgacggcagcaacaggcggagccagaacaccaagggcaacaacaaggtggaagatagagtgtgcagcctgtacagcagccggtccaacgagaaccgcgagagcccttatgccgtggtggacgtgtccagcatgatcgagagcacccccaccagcggcgagacaaccagagctagtagaggcgtgctgagccggttccagaggggcctcgtgcggattgctgacaaagtgcggagagccgtgcagtgcgcttggagcagcgtgtccacaagcagaagcagcgccacaagagccgccgagagcggcagctctagcagaacagctagaggcgccagcagcggctacagagagtacagcccttctgccgctcggggcctgcggctgatgttcaccgacttttggcggacccgggtgctgagacagacctctcctatggccggcgtgttcggcaacctggacgtgaacgaggccagactgatggccgcctacaccagcgagtgtgccgatcacctggaagccaaagagctggccggacctgacggcgtggcagccgctagagaaatcgccaagagatgggagaagagagtgcgggacctgcaggacaagggcgctgccagaaagctgctgaacgaccccctgggcagacggacccccaactaccagagcaagaaccccggcgagtacaccgtgggcaactccatgttctacgacggcccccaggtggccaacctgcagaatgtggataccggcttctggctggacatgagcaacctgagcgacgtggtgctgtccagagagatccagaccggcctgagagccagagccaccctggaagagtccatgcccatgctggaaaatctggaagagagattccggcggctgcaggaaacctgcgacgccgccagaaccgagatcgaggaaagcggctggacccgggaaagcgcctccagaatggaaggcgacgaagcccagggccccagcagagtgcagcaggcctttcagagcttcgtgaatgagtgcaacagcatcgagttcagcttcggctccttcggcgagcacgtgcgggtgctgtgtgccagagtgtcaagaggactggccgctgccggcgaggccatcagaagatgcttcagctgctgcaagggcagcacccacagatacgcccccagagatgacctgtctcctgagggcgcctctctggccgaaaccctggccagattcgccgacgacatgggcatcgaaagaggcgccgacggcacctacgacatccccctggtggacgattggagaaggggcgtgccatccatcgagggcgagggcagcgatagcatctacgagatcatgatgcccatctacgaagtgatgaacatggacctggaaacccggcggagcttcgccgtgcagcagggccattaccaggaccccagagccagcgactacgacctgcctagagcctccgattacgatctgcccagaagcccctaccccacccctccactgcctcccagataccagctgcagaacatggatgtggaagccggctttcgcgaggccgtgtacgcctcttttgtggccggcatgtacaactacgtcgtgacccagccccaggaacggatccccaatagccagcaggtggaaggcatcctgcgggacatgctgaccaacggcagc

SEQ ID NO: 201 - DNA, 1434 bp, Artificial Sequence
  Synthetic Polynucleotide
atggaaacccctgcccagctgctgttcctgctgctgctgtggctgcctgacaccaccggcatgagcatcagaggcgtgggcggcaacggcaacagcagaatccctagccacaacggcgacggcagcaacaggcggagccagaacaccaagggcaacaacaaggtggaagatagagtgtgcagcctgtacagcagccggtccaacgagaaccgcgagagcccttatgccgtggtggacgtgtccagcatgatcgagagcacccccaccagcggcgagacaaccagagctagtagaggcgtgctgagccggttccagaggggcctcgtgcggattgctgacaaagtgcggagagccgtgcagtgcgcttggagcagcgtgtccacaagcagaagcagcgccacaagagccgccgagagcggcagctctagcagaacagctagaggcgccagcagcggctacagagagtacagcccttctgccgctcggggcctgcggctgatgttcaccgacttttggcggacccgggtgctgagacagacctctcctatggccggcgtgttcggcaacctggacgtgaacgaggccagactgatggccgcctacaccagcgagtgtgccgatcacctggaagccaaagagctggccggacctgacggcgtggcagccgctagagaaatcgccaagagatgggagaagagagtgcgggacctgcaggacaagggcgctgccagaaagctgctgaacgaccccctgggcagacggacccccaactaccagagcaagaaccccggcgagtacaccgtgggcaactccatgttctacgacggcccccaggtggccaacctgcagaatgtggataccggcttctggctggacatgagcaacctgagcgacgtggtgctgtccagagagatccagaccggcctgagagccagagccaccctggaagagtccatgcccatgctggaaaatctggaagagagattccggcggctgcaggaaacctgcgacgccgccagaaccgagatcgaggaaagcggctggacccgggaaagcgcctccagaatggaaggcgacgaagcccagggccccagcagagtgcagcaggcctttcagagcttcgtgaatgagtgcaacagcatcgagttcagcttcggctccttcggcgagcacgtgcgggtgctgtgtgccagagtgtcaagaggactggccgctgccggcgaggccatcagaagatgcttcagctgctgcaagggcagcacccacagatacgcccccagagatgacctgtctcctgagggcgcctctctggccgaaaccctggccagattcgccgacgacatgggcatcgaaagaggcgccgacggcacctacgacatccccctggtggacgattggagaaggggcgtgccatccatcgagggcgagggcagc

SEQ ID NO: 202 - DNA, 1800 bp, Artificial Sequence
  Synthetic Polynucleotide
atggaaacccctgctcagctgctgttcctgctgctgctgtggctgcctgataccaccggcatgtctatcagaggcgttggcggcaacggcaacagcagaatccctagccataatggcgacggcagcaacaggcggagccagaataccaagggcaacaacaaggtggaagatcgcgtgtgcagcctgtacagctccagaagcaacgagaaccgcgagagcccttatgccgtggtggatgtgtccagcatgatcgagagcacccctaccagcggcgagacaacaagagctagtagaggcgtgctgagccggtttcagagaggcctcgttcggatcgctgacaaagtgcggagagccgtgcagtgtgcctggtctagtgtgtccacaagcagaagcagcgccacaagagccgccgagagcggatcttctagcagaacagctagaggcgccagcagcggctacagagagtattctccatctgccgccagaggcctgcggctgatgtttacagatttctggcggacccgggtgctgagacagacatctcctatggctggcgtgttcggcaacctggatgtgaatgaggccagactgatggccgcctacacaagcgaatgtgccgatcacctggaagccaaagagctggctggacctgacggtgttgccgccgctagagaaatcgccaagagatgggagaagagagtgcgggacctgcaggataagggcgctgctagaaagctgctgaacgaccctctgggcagaagaacccctaactaccagagcaagaaccccggcgagtacaccgtgggcaactccatgttctacgacggaccccaggtggccaacctgcagaatgtggatacaggcttctggctggatatgcagcacctgagcgacgtggtgctgtccagagagatccagacaggcctgagagccagagccacactggaagagtccatgcctatgctcgagaacctggaagagagattccggcggctgcaagagacatgtgacgccgccagaaccgagatcgaggaaagcggctggacaagagaaagcgcctccagaatggaaggcgacgaagcccaaggacctagcagagtgcagcaggccttccagagcttcgtgaacgagtgcaacagcatcgagttcagcttcggctccttcggcgaacatgtgcgggtgctgtgtgccagagttagcagaggacttgctgccgctggcgaggccatcagaagatgcttctcttgctgcaagggcagcacccacagatacgcccctagagatgatctgagccctgagggcgcttctctggccgaaacactggccagattcgccgacgatatgggcattgaaagaggcgccgacggaacctacgacatccctctggtggacgattggagaaggggcgtgccatctatcgaaggcgagggcagcgatagcatctacgagatcatgatgcccatctacgaagtgatgaacatggacctggaaacccggcggagctttgccgtgcagcaaggccattaccaggatcctagagccagcgactacgacctgcctagagcctccgattatgatctgcctcggagcccctatcctacacctcctctgcctccaagataccagcttcagaatatggacgtggaagccggattccgcgaggccgtgtatgctagctttgtggccggcatgtacaactacgtggtcacccagcctcaagagagaatccccaacagccagcaggtcgagggcatcctgagagatatgctgaccaacggcgaccaccaccatcaccatcat

SEQ ID NO: 203 - DNA, 2529 bp, Artificial Sequence
  Synthetic Polynucleotide
atggaaacccctgctcagctgctgttcctgctgctgctgtggctgcctgatacaaccggcgagcctaagagctgcgacaagacccacacctgtcctccatgtcctgctccagaactgctcggcggaccttccgtgttcctgtttcctccaaagcctaaggacaccctgatgatcagcagaacccctgaagtgacctgcgtggtggtggatgtgtcccacgaggatcccgaagtgaagttcaattggtacgtggacggcgtggaagtgcacaacgccaagaccaagcctagagaggaacagtacaacagcacctacagagtggtgtccgtgctgaccgtgctgcaccaggattggctgaacggcaaagagtacaagtgcaaggtgtccaacaaggccctgcctgctcctatcgagaagaccatcagcaaggccaagggccagccaagagaaccccaggtgtacacactgcctccaagcagagatgagctgaccaagaaccaggtgtccctgacctgtctggtcaagggcttctacccctccgatatcgccgtggaatgggagagcaatggccagcctgagaacaactacaagacaacccctcctgtgctggacagcgacggctcattcttcctgtacagcaagctgacagtggacaagagcagatggcagcagggcaacgtgttcagctgcagcgtgatgcacgaggccctgcacaatcactacacccagaagtccctgtctctgagccccggcaagatgagcatcagaggcgttggcggcaacggcaacagcagaatccctagccataatggcgacggcagcaacaggcggagccagaataccaagggcaacaacaaggtggaagatcgcgtgtgcagcctgtactccagcagaagcaacgagaaccgcgagagcccttatgccgtggtcgacgtgtccagcatgatcgagagcacacctaccagcggcgagacaaccagagctagtagaggcgtgctgagccggtttcagagaggcctcgttcggatcgctgacaaagtgcggagagccgtgcagtgtgcctggtctagtgtgtccaccagcagatcctctgccacaagagccgccgagtctggcagctctagcagaacagctagaggcgccagcagcggctacagagagtattctccatctgccgccagaggcctgcggctgatgtttacagatttctggcggacccgggtgctgagacagacatctcctatggctggcgtgttcggcaacctggatgtgaatgaggccagactgatggccgcctacacaagcgaatgtgccgatcacctggaagccaaagagctggctggacctgacggtgttgccgccgctagagaaatcgccaagagatgggagaagagagtgcgggacctgcaggataagggcgctgctagaaagctgctgaacgaccctctgggcagaagaacccctaactaccagagcaagaaccccggcgagtacaccgtgggcaactccatgttctacgacggacctcaggtggccaacctgcagaatgtggataccggcttctggctggatatgcagcacctgtccgatgtggtgctgtccagagagatccagaccggcctgagagccagagccacactggaagagtccatgcctatgctcgagaacctggaagagagattccggcggctgcaagagacatgtgacgccgccagaaccgagatcgaggaaagcggctggaccagagaaagcgcctccagaatggaaggcgacgaagcccaaggacctagcagagtgcagcaggccttccagagcttcgtgaacgagtgcaacagcatcgagttcagcttcggctccttcggcgaacatgtgcgggtgctgtgtgccagagttagcagaggacttgctgccgctggcgaggccatcagaagatgcttctcttgctgcaagggcagcacccacagatacgcccctagagatgatctgagccctgagggcgcatctctggccgaaacactggccagattcgccgacgatatgggcattgaaagaggcgccgacggaacctacgacatccctctggtggacgattggagaaggggcgtgccatctatcgaaggcgagggcagcgatagcatctacgagatcatgatgcccatctacgaagtgatgaacatggacctggaaacccggcggagcttcgctgttcagcagggccattaccaggatcctagagccagcgactacgacctgcctagagcctccgattatgatctgcctcggagcccctatcctacacctccactgccacctagataccagctccagaatatggacgtggaagccggattccgcgaggccgtgtatgctagctttgtggccggcatgtacaactacgtggtcacccagcctcaagagcggatccccaattctcagcaggtcgagggcatcctgagggacatgctgaccaatggcgaccagaccttccgggacctgatgaagagatggaacagagaggtggacagagag

SEQ ID NO: 204 - DNA, 2547 bp, Artificial Sequence
  Synthetic Polynucleotide
atggaaacccctgctcagctgctgttcctgctgctgctgtggctgcctgatacaaccggcgagcctaagagctgcgacaagacccacacctgtcctccatgtcctgctccagaactgctcggcggaccttccgtgttcctgtttcctccaaagcctaaggacaccctgatgatcagcagaacccctgaagtgacctgcgtggtggtggatgtgtcccacgaggatcccgaagtgaagttcaattggtacgtggacggcgtggaagtgcacaacgccaagaccaagcctagagaggaacagtacaacagcacctacagagtggtgtccgtgctgaccgtgctgcaccaggattggctgaacggcaaagagtacaagtgcaaggtgtccaacaaggccctgcctgctcctatcgagaagaccatcagcaaggccaagggccagccaagagaaccccaggtgtacacactgcctccaagcagagatgagctgaccaagaaccaggtgtccctgacctgtctggtcaagggcttctacccctccgatatcgccgtggaatgggagagcaatggccagcctgagaacaactacaagacaacccctcctgtgctggacagcgacggctcattcttcctgtacagcaagctgacagtggacaagagcagatggcagcagggcaacgtgttcagctgcagcgtgatgcacgaggccctgcacaatcactacacccagaagtccctgtctctgagccccggcaagatgagcatcagaggcgttggcggcaacggcaacagcagaatccctagccataatggcgacggcagcaacaggcggagccagaataccaagggcaacaacaaggtggaagatcgcgtgtgcagcctgtactccagcagaagcaacgagaaccgcgagagcccttatgccgtggtcgacgtgtccagcatgatcgagagcacacctaccagcggcgagacaaccagagctagtagaggcgtgctgagccggtttcagagaggcctcgttcggatcgctgacaaagtgcggagagccgtgcagtgtgcctggtctagtgtgtccaccagcagatcctctgccacaagagccgccgagtctggcagctctagcagaacagctagaggcgccagcagcggctacagagagtattctccatctgccgccagaggcctgcggctgatgtttacagatttctggcggacccgggtgctgagacagacatctcctatggctggcgtgttcggcaacctggatgtgaatgaggccagactgatggccgcctacacaagcgaatgtgccgatcacctggaagccaaagagctggctggacctgacggtgttgccgccgctagagaaatcgccaagagatgggagaagagagtgcgggacctgcaggataagggcgctgctagaaagctgctgaacgaccctctgggcagaagaacccctaactaccagagcaagaaccccggcgagtacaccgtgggcaactccatgttctacgacggacctcaggtggccaacctgcagaatgtggataccggcttctggctggatatgcagcacctgtccgatgtggtgctgtccagagagatccagaccggcctgagagccagagccacactggaagagtccatgcctatgctcgagaacctggaagagagattccggcggctgcaagagacatgtgacgccgccagaaccgagatcgaggaaagcggctggaccagagaaagcgcctccagaatggaaggcgacgaagcccaaggacctagcagagtgcagcaggccttccagagcttcgtgaacgagtgcaacagcatcgagttcagcttcggctccttcggcgaacatgtgcgggtgctgtgtgccagagttagcagaggacttgctgccgctggcgaggccatcagaagatgcttctcttgctgcaagggcagcacccacagatacgcccctagagatgatctgagccctgagggcgcatctctggccgaaacactggccagattcgccgacgatatgggcattgaaagaggcgccgacggaacctacgacatccctctggtggacgattggagaaggggcgtgccatctatcgaaggcgagggcagcgatagcatctacgagatcatgatgcccatctacgaagtgatgaacatggacctggaaacccggcggagcttcgctgttcagcagggccattaccaggatcctagagccagcgactacgacctgcctagagcctccgattatgatctgcctcggagcccctatcctacacctccactgccacctagataccagctccagaatatggacgtggaagccggattccgcgaggccgtgtatgctagctttgtggccggcatgtacaactacgtggtcacccagcctcaagagcggatccccaattctcagcaggtcgagggcatcctgagggacatgctgaccaatggcgaccagaccttccgggacctgatgaagagatggaacagagaggtggaccgcgagcaccaccaccatcaccat

SEQ ID NO: 205 - DNA, 2436 bp, Artificial Sequence
  Synthetic Polynucleotide
atggaaacccctgctcagctgctgttcctgctgctgctgtggctgcctgataccacaggcatgagccctatcctcggctactggaagatcaaaggcctggtgcagcccaccagactgctgctggaatacctggaagagaagtacgaggaacacctgtacgagcgcgacgagggcgataagtggcggaacaagaagttcgagctgggcctcgagttccccaacctgccttactacatcgacggcgacgtgaagctgacccagagcatggccatcatccggtatatcgccgacaagcacaacatgctcggcggctgccctaaagagcgggccgagatttctatgctggaaggcgccgtgctggacatcagatacggcgtgtccagaatcgcctacagcaaggacttcgaaaccctgaaggtggacttcctgagcaagctgcccgagatgctgaagatgttcgaggaccggctgtgccacaagacctacctgaatggcgaccacgtgacacaccccgacttcatgctgtacgacgccctggatgtggtgctgtacatggaccccatgtgcctggacgcctttccaaagctcgtgtgcttcaagaagcggatcgaggccattcctcagatcgacaagtacctgaagtccagcaagtatatcgcttggcccctgcaaggctggcaggccacatttggaggcggagatcaccctcctaagatgagcatcagaggcgtcggcggcaacggcaacagcagaatcccttctcacaatggcgacggcagcaacaggcggagccagaataccaagggcaacaacaaggtggaagatcgcgtgtgcagcctgtacagctccagaagcaacgagaaccgcgagagcccttatgccgtggtggatgtgtccagcatgatcgagagcacccctaccagcggcgagacaacaagagctagtagaggcgtgctgagccggtttcagagaggcctcgttcggattgccgacaaagtgcggagagccgtgcagtgtgcttggagcagtgtgtccacaagcagaagcagcgccacaagagccgccgaatctggcagctctagcagaacagctagaggcgccagcagcggctacagagagtattctccatctgccgccagaggcctgcggctgatgtttacagatttctggcggacccgggtgctgagacagacatctcctatggctggcgtgttcggcaacctggacgtgaacgaagccagactgatggccgcctacacaagcgagtgtgccgatcacctggaagccaaagaactggccggacctgatggcgtggcagccgctagagaaatcgccaagagatgggagaagagagtgcgggacctgcaggataagggcgctgctagaaagctgctgaacgaccctctgggcagaagaacccctaactaccagagcaagaaccccggcgagtacaccgtgggcaactccatgttctacgacggaccccaggtggccaacctgcagaatgtggatacaggcttctggctggacatgcagcacctgtctgatgtggtcctgagcagagagatccagaccggcctgagagccagagccacactggaagagtccatgcctatgctcgagaatctggaagaacggttcagacggctgcaagagacatgcgacgccgccagaacagagatcgaggaaagcggctggaccagagaaagcgcctccagaatggaaggcgacgaagcccaaggacctagcagagtgcagcaggccttccagagcttcgtgaacgagtgcaacagcatcgagttcagcttcggctccttcggcgaacatgtgcgggtgctgtgtgccagagttagcagaggacttgctgccgctggcgaggccatcagaagatgcttctcttgctgcaagggcagcacccacagatacgcccctagagatgatctgagccctgagggcgcatctctggccgaaacactggccagatttgccgacgacatgggcattgaaagaggcgccgacggaacctacgacatccctctggtggacgattggagaaggggcgtgccatctatcgaaggcgagggcagcgatagcatctacgagatcatgatgcccatctacgaagtgatgaacatggacctggaaacccggcggagctttgccgtgcaacagggccattaccaggatcctagagccagcgactacgacctgcctagagcctccgattatgatctgcctcggagcccctatcctacacctcctctgcctccaagataccagcttcagaatatggacgtggaagccggattccgcgaggccgtgtatgctagctttgtggccggcatgtacaactacgtggtcacccagcctcaagagagaatccccaacagccagcaggtcgagggcatcctgagagatatgctgaccaacggcgac

SEQ ID NO: 206 - DNA, 2454 bp, Artificial Sequence
  Synthetic Polynucleotide
atggaaacccctgctcagctgctgttcctgctgctgctgtggctgcctgataccacaggcatgagccctatcctcggctactggaagatcaaaggcctggtgcagcccaccagactgctgctggaatacctggaagagaagtacgaggaacacctgtacgagcgcgacgagggcgataagtggcggaacaagaagttcgagctgggcctcgagttccccaacctgccttactacatcgacggcgacgtgaagctgacccagagcatggccatcatccggtatatcgccgacaagcacaacatgctcggcggctgccctaaagagcgggccgagatttctatgctggaaggcgccgtgctggacatcagatacggcgtgtccagaatcgcctacagcaaggacttcgaaaccctgaaggtggacttcctgagcaagctgcccgagatgctgaagatgttcgaggaccggctgtgccacaagacctacctgaatggcgaccacgtgacacaccccgacttcatgctgtacgacgccctggatgtggtgctgtacatggaccccatgtgcctggacgcctttccaaagctcgtgtgcttcaagaagcggatcgaggccattcctcagatcgacaagtacctgaagtccagcaagtatatcgcttggcccctgcaaggctggcaggccacatttggaggcggagatcaccctcctaagatgagcatcagaggcgtcggcggcaacggcaacagcagaatcccttctcacaatggcgacggcagcaacaggcggagccagaataccaagggcaacaacaaggtggaagatcgcgtgtgcagcctgtacagctccagaagcaacgagaaccgcgagagcccttatgccgtggtggatgtgtccagcatgatcgagagcacccctaccagcggcgagacaacaagagctagtagaggcgtgctgagccggtttcagagaggcctcgttcggattgccgacaaagtgcggagagccgtgcagtgtgcttggagcagtgtgtccacaagcagaagcagcgccacaagagccgccgaatctggcagctctagcagaacagctagaggcgccagcagcggctacagagagtattctccatctgccgccagaggcctgcggctgatgtttacagatttctggcggacccgggtgctgagacagacatctcctatggctggcgtgttcggcaacctggacgtgaacgaagccagactgatggccgcctacacaagcgagtgtgccgatcacctggaagccaaagaactggccggacctgatggcgtggcagccgctagagaaatcgccaagagatgggagaagagagtgcgggacctgcaggataagggcgctgctagaaagctgctgaacgaccctctgggcagaagaacccctaactaccagagcaagaaccccggcgagtacaccgtgggcaactccatgttctacgacggaccccaggtggccaacctgcagaatgtggatacaggcttctggctggacatgcagcacctgtctgatgtggtcctgagcagagagatccagaccggcctgagagccagagccacactggaagagtccatgcctatgctcgagaatctggaagaacggttcagacggctgcaagagacatgcgacgccgccagaacagagatcgaggaaagcggctggaccagagaaagcgcctccagaatggaaggcgacgaagcccaaggacctagcagagtgcagcaggccttccagagcttcgtgaacgagtgcaacagcatcgagttcagcttcggctccttcggcgaacatgtgcgggtgctgtgtgccagagttagcagaggacttgctgccgctggcgaggccatcagaagatgcttctcttgctgcaagggcagcacccacagatacgcccctagagatgatctgagccctgagggcgcatctctggccgaaacactggccagatttgccgacgacatgggcattgaaagaggcgccgacggaacctacgacatccctctggtggacgattggagaaggggcgtgccatctatcgaaggcgagggcagcgatagcatctacgagatcatgatgcccatctacgaagtgatgaacatggacctggaaacccggcggagctttgccgtgcaacagggccattaccaggatcctagagccagcgactacgacctgcctagagcctccgattatgatctgcctcggagcccctatcctacacctcctctgcctccaagataccagcttcagaatatggacgtggaagccggattccgcgaggccgtgtatgctagctttgtggccggcatgtacaactacgtggtcacccagcctcaagagagaatccccaacagccagcaggtcgagggcatcctgagagatatgctgaccaacggcgaccaccaccatcaccatcat

SEQ ID NO: 207 - DNA, 2487 bp, Artificial Sequence
  Synthetic Polynucleotide
atggaaacccctgctcagctgctgttcctgctgctgctgtggctgcctgataccacaggcatgagccctatcctcggctactggaagatcaaaggcctggtgcagcccaccagactgctgctggaatacctggaagagaagtacgaggaacacctgtacgagcgcgacgagggcgataagtggcggaacaagaagttcgagctgggcctcgagttccccaacctgccttactacatcgacggcgacgtgaagctgacccagagcatggccatcatccggtatatcgccgacaagcacaacatgctcggcggctgccctaaagagcgggccgagatttctatgctggaaggcgccgtgctggacatcagatacggcgtgtccagaatcgcctacagcaaggacttcgaaaccctgaaggtggacttcctgagcaagctgcccgagatgctgaagatgttcgaggaccggctgtgccacaagacctacctgaatggcgaccacgtgacacaccccgacttcatgctgtacgacgccctggatgtggtgctgtacatggaccccatgtgcctggacgcctttccaaagctcgtgtgcttcaagaagcggatcgaggccattcctcagatcgacaagtacctgaagtccagcaagtatatcgcttggcccctgcaaggctggcaggccacatttggaggcggagatcaccctcctaagatgagcatcagaggcgtcggcggcaacggcaacagcagaatcccttctcacaatggcgacggcagcaacaggcggagccagaataccaagggcaacaacaaggtggaagatcgcgtgtgcagcctgtacagctccagaagcaacgagaaccgcgagagcccttatgccgtggtggatgtgtccagcatgatcgagagcacccctaccagcggcgagacaacaagagctagtagaggcgtgctgagccggtttcagagaggcctcgttcggattgccgacaaagtgcggagagccgtgcagtgtgcttggagcagtgtgtccacaagcagaagcagcgccacaagagccgccgaatctggcagctctagcagaacagctagaggcgccagcagcggctacagagagtattctccatctgccgccagaggcctgcggctgatgtttacagatttctggcggacccgggtgctgagacagacatctcctatggctggcgtgttcggcaacctggacgtgaacgaagccagactgatggccgcctacacaagcgagtgtgccgatcacctggaagccaaagaactggccggacctgatggcgtggcagccgctagagaaatcgccaagagatgggagaagagagtgcgggacctgcaggataagggcgctgctagaaagctgctgaacgaccctctgggcagaagaacccctaactaccagagcaagaaccccggcgagtacaccgtgggcaactccatgttctacgacggaccccaggtggccaacctgcagaatgtggatacaggcttctggctggacatgcagcacctgtctgatgtggtcctgagcagagagatccagaccggcctgagagccagagccacactggaagagtccatgcctatgctcgagaatctggaagaacggttcagacggctgcaagagacatgcgacgccgccagaacagagatcgaggaaagcggctggaccagagaaagcgcctccagaatggaaggcgacgaagcccaaggacctagcagagtgcagcaggccttccagagcttcgtgaacgagtgcaacagcatcgagttcagcttcggctccttcggcgaacatgtgcgggtgctgtgtgccagagttagcagaggacttgctgccgctggcgaggccatcagaagatgcttctcttgctgcaagggcagcacccacagatacgcccctagagatgatctgagccctgagggcgcatctctggccgaaacactggccagatttgccgacgacatgggcattgaaagaggcgccgacggaacctacgacatccctctggtggacgattggagaaggggcgtgccatctatcgaaggcgagggcagcgatagcatctacgagatcatgatgcccatctacgaagtgatgaacatggacctggaaacccggcggagctttgccgtgcaacagggccattaccaggatcctagagccagcgactacgacctgcctagagcctccgattatgatctgcctcggagcccctatcctacacctcctctgcctccaagataccagcttcagaatatggacgtggaagccggattccgcgaggccgtgtatgctagctttgtggccggcatgtacaactacgtggtcacccagcctcaagagagaatccccaacagccagcaggtcgagggcatcctgagagatatgctgaccaacggcgaccagaccttccgcgacctgatgaagagatggaacagagaggtggacagagag

SEQ ID NO: 208 - DNA, 2505 bp, Artificial Sequence
  Synthetic Polynucleotide
atggaaacccctgctcagctgctgttcctgctgctgctgtggctgcctgataccacaggcatgagccctatcctcggctactggaagatcaaaggcctggtgcagcccaccagactgctgctggaatacctggaagagaagtacgaggaacacctgtacgagcgcgacgagggcgataagtggcggaacaagaagttcgagctgggcctcgagttccccaacctgccttactacatcgacggcgacgtgaagctgacccagagcatggccatcatccggtatatcgccgacaagcacaacatgctcggcggctgccctaaagagcgggccgagatttctatgctggaaggcgccgtgctggacatcagatacggcgtgtccagaatcgcctacagcaaggacttcgaaaccctgaaggtggacttcctgagcaagctgcccgagatgctgaagatgttcgaggaccggctgtgccacaagacctacctgaatggcgaccacgtgacacaccccgacttcatgctgtacgacgccctggatgtggtgctgtacatggaccccatgtgcctggacgcctttccaaagctcgtgtgcttcaagaagcggatcgaggccattcctcagatcgacaagtacctgaagtccagcaagtatatcgcttggcccctgcaaggctggcaggccacatttggaggcggagatcaccctcctaagatgagcatcagaggcgtcggcggcaacggcaacagcagaatcccttctcacaatggcgacggcagcaacaggcggagccagaataccaagggcaacaacaaggtggaagatcgcgtgtgcagcctgtacagctccagaagcaacgagaaccgcgagagcccttatgccgtggtggatgtgtccagcatgatcgagagcacccctaccagcggcgagacaacaagagctagtagaggcgtgctgagccggtttcagagaggcctcgttcggattgccgacaaagtgcggagagccgtgcagtgtgcttggagcagtgtgtccacaagcagaagcagcgccacaagagccgccgaatctggcagctctagcagaacagctagaggcgccagcagcggctacagagagtattctccatctgccgccagaggcctgcggctgatgtttacagatttctggcggacccgggtgctgagacagacatctcctatggctggcgtgttcggcaacctggacgtgaacgaagccagactgatggccgcctacacaagcgagtgtgccgatcacctggaagccaaagaactggccggacctgatggcgtggcagccgctagagaaatcgccaagagatgggagaagagagtgcgggacctgcaggataagggcgctgctagaaagctgctgaacgaccctctgggcagaagaacccctaactaccagagcaagaaccccggcgagtacaccgtgggcaactccatgttctacgacggaccccaggtggccaacctgcagaatgtggatacaggcttctggctggacatgcagcacctgtctgatgtggtcctgagcagagagatccagaccggcctgagagccagagccacactggaagagtccatgcctatgctcgagaatctggaagaacggttcagacggctgcaagagacatgcgacgccgccagaacagagatcgaggaaagcggctggaccagagaaagcgcctccagaatggaaggcgacgaagcccaaggacctagcagagtgcagcaggccttccagagcttcgtgaacgagtgcaacagcatcgagttcagcttcggctccttcggcgaacatgtgcgggtgctgtgtgccagagttagcagaggacttgctgccgctggcgaggccatcagaagatgcttctcttgctgcaagggcagcacccacagatacgcccctagagatgatctgagccctgagggcgcatctctggccgaaacactggccagatttgccgacgacatgggcattgaaagaggcgccgacggaacctacgacatccctctggtggacgattggagaaggggcgtgccatctatcgaaggcgagggcagcgatagcatctacgagatcatgatgcccatctacgaagtgatgaacatggacctggaaacccggcggagctttgccgtgcaacagggccattaccaggatcctagagccagcgactacgacctgcctagagcctccgattatgatctgcctcggagcccctatcctacacctcctctgcctccaagataccagcttcagaatatggacgtggaagccggattccgcgaggccgtgtatgctagctttgtggccggcatgtacaactacgtggtcacccagcctcaagagagaatccccaacagccagcaggtcgagggcatcctgagagatatgctgaccaacggcgaccagaccttccgcgacctgatgaagagatggaacagagaggtggacagagagcaccaccaccatcaccat

SEQ ID NO: 209 - DNA, 2088 bp, Artificial Sequence
  Synthetic Polynucleotide
atggaaacccctgctcagctgctgttcctgctgctgctgtggctgcctgataccacaggcatgagccctatcctcggctactggaagatcaaaggcctggtgcagcccaccagactgctgctggaatacctggaagagaagtacgaggaacacctgtacgagcgcgacgagggcgataagtggcggaacaagaagttcgagctgggcctcgagttccccaacctgccttactacatcgacggcgacgtgaagctgacccagagcatggccatcatccggtatatcgccgacaagcacaacatgctcggcggctgccctaaagagcgggccgagatttctatgctggaaggcgccgtgctggacatcagatacggcgtgtccagaatcgcctacagcaaggacttcgaaaccctgaaggtggacttcctgagcaagctgcccgagatgctgaagatgttcgaggaccggctgtgccacaagacctacctgaatggcgaccacgtgacacaccccgacttcatgctgtacgacgccctggatgtggtgctgtacatggaccccatgtgcctggacgcctttccaaagctcgtgtgcttcaagaagcggatcgaggccattcctcagatcgacaagtacctgaagtccagcaagtatatcgcttggcccctgcaaggctggcaggccacatttggaggcggagatcaccctcctaagatgagcatcagaggcgtcggcggcaacggcaacagcagaatcccttctcacaatggcgacggcagcaacaggcggagccagaataccaagggcaacaacaaggtggaagatcgcgtgtgcagcctgtacagctccagaagcaacgagaaccgcgagagcccttatgccgtggtggatgtgtccagcatgatcgagagcacccctaccagcggcgagacaacaagagctagtagaggcgtgctgagccggtttcagagaggcctcgttcggattgccgacaaagtgcggagagccgtgcagtgtgcttggagcagtgtgtccacaagcagaagcagcgccacaagagccgccgaatctggcagctctagcagaacagctagaggcgccagcagcggctacagagagtattctccatctgccgccagaggcctgcggctgatgtttacagatttctggcggacccgggtgctgagacagacatctcctatggctggcgtgttcggcaacctggacgtgaacgaagccagactgatggccgcctacacaagcgagtgtgccgatcacctggaagccaaagaactggccggacctgatggcgtggcagccgctagagaaatcgccaagagatgggagaagagagtgcgggacctgcaggataagggcgctgctagaaagctgctgaacgaccctctgggcagaagaacccctaactaccagagcaagaaccccggcgagtacaccgtgggcaactccatgttctacgacggaccccaggtggccaacctgcagaatgtggatacaggcttctggctggacatgcagcacctgtctgatgtggtcctgagcagagagatccagaccggcctgagagccagagccacactggaagagtccatgcctatgctcgagaatctggaagaacggttcagacggctgcaagagacatgcgacgccgccagaacagagatcgaggaaagcggctggaccagagaaagcgcctccagaatggaaggcgacgaagcccaaggacctagcagagtgcagcaggccttccagagcttcgtgaacgagtgcaacagcatcgagttcagcttcggctccttcggcgaacatgtgcgggtgctgtgtgccagagttagcagaggacttgctgccgctggcgaggccatcagaagatgcttctcttgctgcaagggcagcacccacagatacgcccctagagatgatctgagccctgagggcgcatctctggccgaaacactggccagatttgccgacgacatgggcattgaaagaggcgccgacggaacctacgacatccctctggtggacgattggagaaggggcgtgccatctatcgaaggcgagggatct

SEQ ID NO: 210 - DNA, 2106 bp, Artificial Sequence
  Synthetic Polynucleotide
atggaaacccctgctcagctgctgttcctgctgctgctgtggctgcctgataccacaggcatgagccctatcctcggctactggaagatcaaaggcctggtgcagcccaccagactgctgctggaatacctggaagagaagtacgaggaacacctgtacgagcgcgacgagggcgataagtggcggaacaagaagttcgagctgggcctcgagttccccaacctgccttactacatcgacggcgacgtgaagctgacccagagcatggccatcatccggtatatcgccgacaagcacaacatgctcggcggctgccctaaagagcgggccgagatttctatgctggaaggcgccgtgctggacatcagatacggcgtgtccagaatcgcctacagcaaggacttcgaaaccctgaaggtggacttcctgagcaagctgcccgagatgctgaagatgttcgaggaccggctgtgccacaagacctacctgaatggcgaccacgtgacacaccccgacttcatgctgtacgacgccctggatgtggtgctgtacatggaccccatgtgcctggacgcctttccaaagctcgtgtgcttcaagaagcggatcgaggccattcctcagatcgacaagtacctgaagtccagcaagtatatcgcttggcccctgcaaggctggcaggccacatttggaggcggagatcaccctcctaagatgagcatcagaggcgtcggcggcaacggcaacagcagaatcccttctcacaatggcgacggcagcaacaggcggagccagaataccaagggcaacaacaaggtggaagatcgcgtgtgcagcctgtacagctccagaagcaacgagaaccgcgagagcccttatgccgtggtggatgtgtccagcatgatcgagagcacccctaccagcggcgagacaacaagagctagtagaggcgtgctgagccggtttcagagaggcctcgttcggattgccgacaaagtgcggagagccgtgcagtgtgcttggagcagtgtgtccacaagcagaagcagcgccacaagagccgccgaatctggcagctctagcagaacagctagaggcgccagcagcggctacagagagtattctccatctgccgccagaggcctgcggctgatgtttacagatttctggcggacccgggtgctgagacagacatctcctatggctggcgtgttcggcaacctggacgtgaacgaagccagactgatggccgcctacacaagcgagtgtgccgatcacctggaagccaaagaactggccggacctgatggcgtggcagccgctagagaaatcgccaagagatgggagaagagagtgcgggacctgcaggataagggcgctgctagaaagctgctgaacgaccctctgggcagaagaacccctaactaccagagcaagaaccccggcgagtacaccgtgggcaactccatgttctacgacggaccccaggtggccaacctgcagaatgtggatacaggcttctggctggacatgcagcacctgtctgatgtggtcctgagcagagagatccagaccggcctgagagccagagccacactggaagagtccatgcctatgctcgagaatctggaagaacggttcagacggctgcaagagacatgcgacgccgccagaacagagatcgaggaaagcggctggaccagagaaagcgcctccagaatggaaggcgacgaagcccaaggacctagcagagtgcagcaggccttccagagcttcgtgaacgagtgcaacagcatcgagttcagcttcggctccttcggcgaacatgtgcgggtgctgtgtgccagagttagcagaggacttgctgccgctggcgaggccatcagaagatgcttctcttgctgcaagggcagcacccacagatacgcccctagagatgatctgagccctgagggcgcatctctggccgaaacactggccagatttgccgacgacatgggcattgaaagaggcgccgacggaacctacgacatccctctggtggacgattggagaaggggcgtgccatctatcgaaggcgagggctctcaccaccaccatcaccat

SEQ ID NO: 211 - DNA, 1434 bp, Artificial Sequence
  Synthetic Polynucleotide
atggaaacccctgctcagctgctgttcctgctgctgctgtggctgcctgataccaccggcatgtctatcagaggcgttggcggcaacggcaacagcagaatccctagccataatggcgacggcagcaacaggcggagccagaataccaagggcaacaacaaggtggaagatcgcgtgtgcagcctgtacagctccagaagcaacgagaaccgcgagagcccttatgccgtggtggatgtgtccagcatgatcgagagcacccctaccagcggcgagacaacaagagctagtagaggcgtgctgagccggtttcagagaggcctcgttcggatcgctgacaaagtgcggagagccgtgcagtgtgcctggtctagtgtgtccacaagcagaagcagcgccacaagagccgccgagagcggatcttctagcagaacagctagaggcgccagcagcggctacagagagtattctccatctgccgccagaggcctgcggctgatgtttacagatttctggcggacccgggtgctgagacagacatctcctatggctggcgtgttcggcaacctggatgtgaatgaggccagactgatggccgcctacacaagcgaatgtgccgatcacctggaagccaaagagctggctggacctgacggtgttgccgccgctagagaaatcgccaagagatgggagaagagagtgcgggacctgcaggataagggcgctgctagaaagctgctgaacgaccctctgggcagaagaacccctaactaccagagcaagaaccccggcgagtacaccgtgggcaactccatgttctacgacggaccccaggtggccaacctgcagaatgtggatacaggcttctggctggatatgcagcacctgagcgacgtggtgctgtccagagagatccagacaggcctgagagccagagccacactggaagagtccatgcctatgctcgagaacctggaagagagattccggcggctgcaagagacatgtgacgccgccagaaccgagatcgaggaaagcggctggacaagagaaagcgcctccagaatggaaggcgacgaagcccaaggacctagcagagtgcagcaggccttccagagcttcgtgaacgagtgcaacagcatcgagttcagcttcggctccttcggcgaacatgtgcgggtgctgtgtgccagagttagcagaggacttgctgccgctggcgaggccatcagaagatgcttctcttgctgcaagggcagcacccacagatacgcccctagagatgatctgagccctgagggcgcttctctggccgaaacactggccagattcgccgacgatatgggcattgaaagaggcgccgacggaacctacgacatccctctggtggacgattggagaaggggcgtgccatctatcgaaggcgagggatct

SEQ ID NO: 212 - DNA, 1452 bp, Artificial Sequence
  Synthetic Polynucleotide
atggaaacccctgctcagctgctgttcctgctgctgctgtggctgcctgataccaccggcatgtctatcagaggcgttggcggcaacggcaacagcagaatccctagccataatggcgacggcagcaacaggcggagccagaataccaagggcaacaacaaggtggaagatcgcgtgtgcagcctgtacagctccagaagcaacgagaaccgcgagagcccttatgccgtggtggatgtgtccagcatgatcgagagcacccctaccagcggcgagacaacaagagctagtagaggcgtgctgagccggtttcagagaggcctcgttcggatcgctgacaaagtgcggagagccgtgcagtgtgcctggtctagtgtgtccacaagcagaagcagcgccacaagagccgccgagagcggatcttctagcagaacagctagaggcgccagcagcggctacagagagtattctccatctgccgccagaggcctgcggctgatgtttacagatttctggcggacccgggtgctgagacagacatctcctatggctggcgtgttcggcaacctggatgtgaatgaggccagactgatggccgcctacacaagcgaatgtgccgatcacctggaagccaaagagctggctggacctgacggtgttgccgccgctagagaaatcgccaagagatgggagaagagagtgcgggacctgcaggataagggcgctgctagaaagctgctgaacgaccctctgggcagaagaacccctaactaccagagcaagaaccccggcgagtacaccgtgggcaactccatgttctacgacggaccccaggtggccaacctgcagaatgtggatacaggcttctggctggatatgcagcacctgagcgacgtggtgctgtccagagagatccagacaggcctgagagccagagccacactggaagagtccatgcctatgctcgagaacctggaagagagattccggcggctgcaagagacatgtgacgccgccagaaccgagatcgaggaaagcggctggacaagagaaagcgcctccagaatggaaggcgacgaagcccaaggacctagcagagtgcagcaggccttccagagcttcgtgaacgagtgcaacagcatcgagttcagcttcggctccttcggcgaacatgtgcgggtgctgtgtgccagagttagcagaggacttgctgccgctggcgaggccatcagaagatgcttctcttgctgcaagggcagcacccacagatacgcccctagagatgatctgagccctgagggcgcttctctggccgaaacactggccagattcgccgacgatatgggcattgaaagaggcgccgacggaacctacgacatccctctggtggacgattggagaaggggcgtgccatctatcgaaggcgagggctctcaccaccaccatcaccat

SEQ ID NO: 213 - DNA, 1782 bp, Artificial Sequence
  Synthetic Polynucleotide
atggaaacccctgctcagctgctgttcctgctgctgctgtggctgcctgataccaccggcatgtctatcagaggcgttggcggcaacggcaacagcagaatccctagccataatggcgacggcagcaacaggcggagccagaataccaagggcaacaacaaggtggaagatcgcgtgtgcagcctgtacagctccagaagcaacgagaaccgcgagagcccttatgccgtggtggatgtgtccagcatgatcgagagcacccctaccagcggcgagacaacaagagctagtagaggcgtgctgagccggtttcagagaggcctcgttcggatcgctgacaaagtgcggagagccgtgcagtgtgcctggtctagtgtgtccacaagcagaagcagcgccacaagagccgccgagagcggatcttctagcagaacagctagaggcgccagcagcggctacagagagtattctccatctgccgccagaggcctgcggctgatgtttacagatttctggcggacccgggtgctgagacagacatctcctatggctggcgtgttcggcaacctggatgtgaatgaggccagactgatggccgcctacacaagcgaatgtgccgatcacctggaagccaaagagctggctggacctgacggtgttgccgccgctagagaaatcgccaagagatgggagaagagagtgcgggacctgcaggataagggcgctgctagaaagctgctgaacgaccctctgggcagaagaacccctaactaccagagcaagaaccccggcgagtacaccgtgggcaactccatgttctacgacggaccccaggtggccaacctgcagaatgtggatacaggcttctggctggatatgcagcacctgagcgacgtggtgctgtccagagagatccagacaggcctgagagccagagccacactggaagagtccatgcctatgctcgagaacctggaagagagattccggcggctgcaagagacatgtgacgccgccagaaccgagatcgaggaaagcggctggacaagagaaagcgcctccagaatggaaggcgacgaagcccaaggacctagcagagtgcagcaggccttccagagcttcgtgaacgagtgcaacagcatcgagttcagcttcggctccttcggcgaacatgtgcgggtgctgtgtgccagagttagcagaggacttgctgccgctggcgaggccatcagaagatgcttctcttgctgcaagggcagcacccacagatacgcccctagagatgatctgagccctgagggcgcttctctggccgaaacactggccagattcgccgacgatatgggcattgaaagaggcgccgacggaacctacgacatccctctggtggacgattggagaaggggcgtgccatctatcgaaggcgagggcagcgatagcatctacgagatcatgatgcccatctacgaagtgatgaacatggacctggaaacccggcggagctttgccgtgcagcaaggccattaccaggatcctagagccagcgactacgacctgcctagagcctccgattatgatctgcctcggagcccctatcctacacctcctctgcctccaagataccagcttcagaatatggacgtggaagccggattccgcgaggccgtgtatgctagctttgtggccggcatgtacaactacgtggtcacccagcctcaagagagaatccccaacagccagcaggtcgagggcatcctgagagatatgctgaccaacggcgac

SEQ ID NO: 214 - DNA, 2436 bp, Artificial Sequence
  Synthetic Polynucleotide
atggaaacccctgctcagctgctgttcctgctgctgctgtggctgcctgataccacaggcatgagccctatcctcggctactggaagatcaaaggcctggtgcagcccaccagactgctgctggaatacctggaagagaagtacgaggaacacctgtacgagcgcgacgagggcgataagtggcggaacaagaagttcgagctgggcctcgagttccccaacctgccttactacatcgacggcgacgtgaagctgacccagagcatggccatcatccggtatatcgccgacaagcacaacatgctcggcggctgccctaaagagcgggccgagatttctatgctggaaggcgccgtgctggacatcagatacggcgtgtccagaatcgcctacagcaaggacttcgaaaccctgaaggtggacttcctgagcaagctgcccgagatgctgaagatgttcgaggaccggctgtgccacaagacctacctgaatggcgaccacgtgacacaccccgacttcatgctgtacgacgccctggatgtggtgctgtacatggaccccatgtgcctggacgcctttccaaagctcgtgtgcttcaagaagcggatcgaggccattcctcagatcgacaagtacctgaagtccagcaagtatatcgcttggcccctgcaaggctggcaggccacatttggaggcggagatcaccctcctaagatgagcatcagaggcgtcggcggcaacggcaacagcagaatcccttctcacaatggcgacggcagcaacaggcggagccagaataccaagggcaacaacaaggtggaagatcgcgtgtgcagcctgtacagctccagaagcaacgagaaccgcgagagcccttatgccgtggtggatgtgtccagcatgatcgagagcacccctaccagcggcgagacaacaagagctagtagaggcgtgctgagccggtttcagagaggcctcgttcggattgccgacaaagtgcggagagccgtgcagtgtgcttggagcagtgtgtccacaagcagaagcagcgccacaagagccgccgaatctggcagctctagcagaacagctagaggcgccagcagcggctacagagagtattctccatctgccgccagaggcctgcggctgatgtttacagatttctggcggacccgggtgctgagacagacatctcctatggctggcgtgttcggcaacctggacgtgaacgaagccagactgatggccgcctacacaagcgagtgtgccgatcacctggaagccaaagaactggccggacctgatggcgtggcagccgctagagaaatcgccaagagatgggagaagagagtgcgggacctgcaggataagggcgctgctagaaagctgctgaacgaccctctgggcagaagaacccctaactaccagagcaagaaccccggcgagtacaccgtgggcaactccatgttctacgacggaccccaggtggccaacctgcagaatgtggatacaggcttctggctggacatgagcaacctgagcgacgtggtcctgagcagagagatccagacaggcctgagagccagagccacactggaagagtccatgcctatgctcgagaatctggaagaacggttcagacggctgcaagagacatgcgacgccgccagaacagagatcgaggaaagcggctggaccagagaaagcgcctccagaatggaaggcgacgaagcccaaggacctagcagagtgcagcaggccttccagagcttcgtgaacgagtgcaacagcatcgagttcagcttcggctccttcggcgaacatgtgcgggtgctgtgtgccagagttagcagaggacttgctgccgctggcgaggccatcagaagatgcttctcttgctgcaagggcagcacccacagatacgcccctagagatgatctgagccctgagggcgcatctctggccgaaacactggccagatttgccgacgacatgggcattgaaagaggcgccgacggaacctacgacatccctctggtggacgattggagaaggggcgtgccatctatcgaaggcgagggcagcgatagcatctacgagatcatgatgcccatctacgaagtgatgaacatggacctggaaacccggcggagctttgccgtgcaacagggccattaccaggatcctagagccagcgactacgacctgcctagagcctccgattatgatctgcctcggagcccctatcctacacctcctctgcctccaagataccagcttcagaatatggacgtggaagccggattccgcgaggccgtgtatgctagctttgtggccggcatgtacaactacgtggtcacccagcctcaagagagaatccccaacagccagcaggtcgagggcatcctgagagatatgctgaccaacggcagc

SEQ ID NO: 215 - DNA, 2454 bp, Artificial Sequence
  Synthetic Polynucleotide
atggaaacccctgctcagctgctgttcctgctgctgctgtggctgcctgataccacaggcatgagccctatcctcggctactggaagatcaaaggcctggtgcagcccaccagactgctgctggaatacctggaagagaagtacgaggaacacctgtacgagcgcgacgagggcgataagtggcggaacaagaagttcgagctgggcctcgagttccccaacctgccttactacatcgacggcgacgtgaagctgacccagagcatggccatcatccggtatatcgccgacaagcacaacatgctcggcggctgccctaaagagcgggccgagatttctatgctggaaggcgccgtgctggacatcagatacggcgtgtccagaatcgcctacagcaaggacttcgaaaccctgaaggtggacttcctgagcaagctgcccgagatgctgaagatgttcgaggaccggctgtgccacaagacctacctgaatggcgaccacgtgacacaccccgacttcatgctgtacgacgccctggatgtggtgctgtacatggaccccatgtgcctggacgcctttccaaagctcgtgtgcttcaagaagcggatcgaggccattcctcagatcgacaagtacctgaagtccagcaagtatatcgcttggcccctgcaaggctggcaggccacatttggaggcggagatcaccctcctaagatgagcatcagaggcgtcggcggcaacggcaacagcagaatcccttctcacaatggcgacggcagcaacaggcggagccagaataccaagggcaacaacaaggtggaagatcgcgtgtgcagcctgtacagctccagaagcaacgagaaccgcgagagcccttatgccgtggtggatgtgtccagcatgatcgagagcacccctaccagcggcgagacaacaagagctagtagaggcgtgctgagccggtttcagagaggcctcgttcggattgccgacaaagtgcggagagccgtgcagtgtgcttggagcagtgtgtccacaagcagaagcagcgccacaagagccgccgaatctggcagctctagcagaacagctagaggcgccagcagcggctacagagagtattctccatctgccgccagaggcctgcggctgatgtttacagatttctggcggacccgggtgctgagacagacatctcctatggctggcgtgttcggcaacctggacgtgaacgaagccagactgatggccgcctacacaagcgagtgtgccgatcacctggaagccaaagaactggccggacctgatggcgtggcagccgctagagaaatcgccaagagatgggagaagagagtgcgggacctgcaggataagggcgctgctagaaagctgctgaacgaccctctgggcagaagaacccctaactaccagagcaagaaccccggcgagtacaccgtgggcaactccatgttctacgacggaccccaggtggccaacctgcagaatgtggatacaggcttctggctggacatgagcaacctgagcgacgtggtcctgagcagagagatccagacaggcctgagagccagagccacactggaagagtccatgcctatgctcgagaatctggaagaacggttcagacggctgcaagagacatgcgacgccgccagaacagagatcgaggaaagcggctggaccagagaaagcgcctccagaatggaaggcgacgaagcccaaggacctagcagagtgcagcaggccttccagagcttcgtgaacgagtgcaacagcatcgagttcagcttcggctccttcggcgaacatgtgcgggtgctgtgtgccagagttagcagaggacttgctgccgctggcgaggccatcagaagatgcttctcttgctgcaagggcagcacccacagatacgcccctagagatgatctgagccctgagggcgcatctctggccgaaacactggccagatttgccgacgacatgggcattgaaagaggcgccgacggaacctacgacatccctctggtggacgattggagaaggggcgtgccatctatcgaaggcgagggcagcgatagcatctacgagatcatgatgcccatctacgaagtgatgaacatggacctggaaacccggcggagctttgccgtgcaacagggccattaccaggatcctagagccagcgactacgacctgcctagagcctccgattatgatctgcctcggagcccctatcctacacctcctctgcctccaagataccagcttcagaatatggacgtggaagccggattccgcgaggccgtgtatgctagctttgtggccggcatgtacaactacgtggtcacccagcctcaagagagaatccccaacagccagcaggtcgagggcatcctgagagatatgctgaccaacggcagccaccaccaccatcaccat

SEQ ID NO: 216 - DNA, 2487 bp, Artificial Sequence
  Synthetic Polynucleotide
atggaaacccctgctcagctgctgttcctgctgctgctgtggctgcctgataccacaggcatgagccctatcctcggctactggaagatcaaaggcctggtgcagcccaccagactgctgctggaatacctggaagagaagtacgaggaacacctgtacgagcgcgacgagggcgataagtggcggaacaagaagttcgagctgggcctcgagttccccaacctgccttactacatcgacggcgacgtgaagctgacccagagcatggccatcatccggtatatcgccgacaagcacaacatgctcggcggctgccctaaagagcgggccgagatttctatgctggaaggcgccgtgctggacatcagatacggcgtgtccagaatcgcctacagcaaggacttcgaaaccctgaaggtggacttcctgagcaagctgcccgagatgctgaagatgttcgaggaccggctgtgccacaagacctacctgaatggcgaccacgtgacacaccccgacttcatgctgtacgacgccctggatgtggtgctgtacatggaccccatgtgcctggacgcctttccaaagctcgtgtgcttcaagaagcggatcgaggccattcctcagatcgacaagtacctgaagtccagcaagtatatcgcttggcccctgcaaggctggcaggccacatttggaggcggagatcaccctcctaagatgagcatcagaggcgtcggcggcaacggcaacagcagaatcccttctcacaatggcgacggcagcaacaggcggagccagaataccaagggcaacaacaaggtggaagatcgcgtgtgcagcctgtacagctccagaagcaacgagaaccgcgagagcccttatgccgtggtggatgtgtccagcatgatcgagagcacccctaccagcggcgagacaacaagagctagtagaggcgtgctgagccggtttcagagaggcctcgttcggattgccgacaaagtgcggagagccgtgcagtgtgcttggagcagtgtgtccacaagcagaagcagcgccacaagagccgccgaatctggcagctctagcagaacagctagaggcgccagcagcggctacagagagtattctccatctgccgccagaggcctgcggctgatgtttacagatttctggcggacccgggtgctgagacagacatctcctatggctggcgtgttcggcaacctggacgtgaacgaagccagactgatggccgcctacacaagcgagtgtgccgatcacctggaagccaaagaactggccggacctgatggcgtggcagccgctagagaaatcgccaagagatgggagaagagagtgcgggacctgcaggataagggcgctgctagaaagctgctgaacgaccctctgggcagaagaacccctaactaccagagcaagaaccccggcgagtacaccgtgggcaactccatgttctacgacggaccccaggtggccaacctgcagaatgtggatacaggcttctggctggacatgagcaacctgagcgacgtggtcctgagcagagagatccagacaggcctgagagccagagccacactggaagagtccatgcctatgctcgagaatctggaagaacggttcagacggctgcaagagacatgcgacgccgccagaacagagatcgaggaaagcggctggaccagagaaagcgcctccagaatggaaggcgacgaagcccaaggacctagcagagtgcagcaggccttccagagcttcgtgaacgagtgcaacagcatcgagttcagcttcggctccttcggcgaacatgtgcgggtgctgtgtgccagagttagcagaggacttgctgccgctggcgaggccatcagaagatgcttctcttgctgcaagggcagcacccacagatacgcccctagagatgatctgagccctgagggcgcatctctggccgaaacactggccagatttgccgacgacatgggcattgaaagaggcgccgacggaacctacgacatccctctggtggacgattggagaaggggcgtgccatctatcgaaggcgagggcagcgatagcatctacgagatcatgatgcccatctacgaagtgatgaacatggacctggaaacccggcggagctttgccgtgcaacagggccattaccaggatcctagagccagcgactacgacctgcctagagcctccgattatgatctgcctcggagcccctatcctacacctcctctgcctccaagataccagcttcagaatatggacgtggaagccggattccgcgaggccgtgtatgctagctttgtggccggcatgtacaactacgtggtcacccagcctcaagagagaatccccaacagccagcaggtcgagggcatcctgagagatatgctgaccaacggcagccagaccttccgcgacctgatgaagagatggaacagagaggtggacagagag

SEQ ID NO: 217 - DNA, 2505 bp, Artificial Sequence
  Synthetic Polynucleotide
atggaaacccctgctcagctgctgttcctgctgctgctgtggctgcctgataccacaggcatgagccctatcctcggctactggaagatcaaaggcctggtgcagcccaccagactgctgctggaatacctggaagagaagtacgaggaacacctgtacgagcgcgacgagggcgataagtggcggaacaagaagttcgagctgggcctcgagttccccaacctgccttactacatcgacggcgacgtgaagctgacccagagcatggccatcatccggtatatcgccgacaagcacaacatgctcggcggctgccctaaagagcgggccgagatttctatgctggaaggcgccgtgctggacatcagatacggcgtgtccagaatcgcctacagcaaggacttcgaaaccctgaaggtggacttcctgagcaagctgcccgagatgctgaagatgttcgaggaccggctgtgccacaagacctacctgaatggcgaccacgtgacacaccccgacttcatgctgtacgacgccctggatgtggtgctgtacatggaccccatgtgcctggacgcctttccaaagctcgtgtgcttcaagaagcggatcgaggccattcctcagatcgacaagtacctgaagtccagcaagtatatcgcttggcccctgcaaggctggcaggccacatttggaggcggagatcaccctcctaagatgagcatcagaggcgtcggcggcaacggcaacagcagaatcccttctcacaatggcgacggcagcaacaggcggagccagaataccaagggcaacaacaaggtggaagatcgcgtgtgcagcctgtacagctccagaagcaacgagaaccgcgagagcccttatgccgtggtggatgtgtccagcatgatcgagagcacccctaccagcggcgagacaacaagagctagtagaggcgtgctgagccggtttcagagaggcctcgttcggattgccgacaaagtgcggagagccgtgcagtgtgcttggagcagtgtgtccacaagcagaagcagcgccacaagagccgccgaatctggcagctctagcagaacagctagaggcgccagcagcggctacagagagtattctccatctgccgccagaggcctgcggctgatgtttacagatttctggcggacccgggtgctgagacagacatctcctatggctggcgtgttcggcaacctggacgtgaacgaagccagactgatggccgcctacacaagcgagtgtgccgatcacctggaagccaaagaactggccggacctgatggcgtggcagccgctagagaaatcgccaagagatgggagaagagagtgcgggacctgcaggataagggcgctgctagaaagctgctgaacgaccctctgggcagaagaacccctaactaccagagcaagaaccccggcgagtacaccgtgggcaactccatgttctacgacggaccccaggtggccaacctgcagaatgtggatacaggcttctggctggacatgagcaacctgagcgacgtggtcctgagcagagagatccagacaggcctgagagccagagccacactggaagagtccatgcctatgctcgagaatctggaagaacggttcagacggctgcaagagacatgcgacgccgccagaacagagatcgaggaaagcggctggaccagagaaagcgcctccagaatggaaggcgacgaagcccaaggacctagcagagtgcagcaggccttccagagcttcgtgaacgagtgcaacagcatcgagttcagcttcggctccttcggcgaacatgtgcgggtgctgtgtgccagagttagcagaggacttgctgccgctggcgaggccatcagaagatgcttctcttgctgcaagggcagcacccacagatacgcccctagagatgatctgagccctgagggcgcatctctggccgaaacactggccagatttgccgacgacatgggcattgaaagaggcgccgacggaacctacgacatccctctggtggacgattggagaaggggcgtgccatctatcgaaggcgagggcagcgatagcatctacgagatcatgatgcccatctacgaagtgatgaacatggacctggaaacccggcggagctttgccgtgcaacagggccattaccaggatcctagagccagcgactacgacctgcctagagcctccgattatgatctgcctcggagcccctatcctacacctcctctgcctccaagataccagcttcagaatatggacgtggaagccggattccgcgaggccgtgtatgctagctttgtggccggcatgtacaactacgtggtcacccagcctcaagagagaatccccaacagccagcaggtcgagggcatcctgagagatatgctgaccaacggcagccagaccttccgcgacctgatgaagagatggaacagagaggtggacagagagcaccaccaccatcaccat

SEQ ID NO: 218 - DNA, 2529 bp, Artificial Sequence
  Synthetic Polynucleotide
atggaaacccctgctcagctgctgttcctgctgctgctgtggctgcctgatacaaccggcgagcctaagagctgcgacaagacccacacctgtcctccatgtcctgctccagaactgctcggcggaccttccgtgttcctgtttcctccaaagcctaaggacaccctgatgatcagcagaacccctgaagtgacctgcgtggtggtggatgtgtcccacgaggatcccgaagtgaagttcaattggtacgtggacggcgtggaagtgcacaacgccaagaccaagcctagagaggaacagtacaacagcacctacagagtggtgtccgtgctgaccgtgctgcaccaggattggctgaacggcaaagagtacaagtgcaaggtgtccaacaaggccctgcctgctcctatcgagaagaccatcagcaaggccaagggccagccaagagaaccccaggtgtacacactgcctccaagcagagatgagctgaccaagaaccaggtgtccctgacctgtctggtcaagggcttctacccctccgatatcgccgtggaatgggagagcaatggccagcctgagaacaactacaagacaacccctcctgtgctggacagcgacggctcattcttcctgtacagcaagctgacagtggacaagagcagatggcagcagggcaacgtgttcagctgcagcgtgatgcacgaggccctgcacaatcactacacccagaagtccctgtctctgagccccggcaagatgagcatcagaggcgttggcggcaacggcaacagcagaatccctagccataatggcgacggcagcaacaggcggagccagaataccaagggcaacaacaaggtggaagatcgcgtgtgcagcctgtactccagcagaagcaacgagaaccgcgagagcccttatgccgtggtcgacgtgtccagcatgatcgagagcacacctaccagcggcgagacaaccagagctagtagaggcgtgctgagccggtttcagagaggcctcgttcggatcgctgacaaagtgcggagagccgtgcagtgtgcctggtctagtgtgtccaccagcagatcctctgccacaagagccgccgagtctggcagctctagcagaacagctagaggcgccagcagcggctacagagagtattctccatctgccgccagaggcctgcggctgatgtttacagatttctggcggacccgggtgctgagacagacatctcctatggctggcgtgttcggcaacctggatgtgaatgaggccagactgatggccgcctacacaagcgaatgtgccgatcacctggaagccaaagagctggctggacctgacggtgttgccgccgctagagaaatcgccaagagatgggagaagagagtgcgggacctgcaggataagggcgctgctagaaagctgctgaacgaccctctgggcagaagaacccctaactaccagagcaagaaccccggcgagtacaccgtgggcaactccatgttctacgacggacctcaggtggccaacctgcagaatgtggataccggcttctggctggatatgagcaacctgagcgacgtggtgctgtccagagagatccagacaggcctgagagccagagccacactggaagagtccatgcctatgctcgagaacctggaagagagattccggcggctgcaagagacatgtgacgccgccagaaccgagatcgaggaaagcggctggaccagagaaagcgcctccagaatggaaggcgacgaagcccaaggacctagcagagtgcagcaggccttccagagcttcgtgaacgagtgcaacagcatcgagttcagcttcggctccttcggcgaacatgtgcgggtgctgtgtgccagagttagcagaggacttgctgccgctggcgaggccatcagaagatgcttctcttgctgcaagggcagcacccacagatacgcccctagagatgatctgagccctgagggcgcatctctggccgaaacactggccagattcgccgacgatatgggcattgaaagaggcgccgacggaacctacgacatccctctggtggacgattggagaaggggcgtgccatctatcgaaggcgagggcagcgatagcatctacgagatcatgatgcccatctacgaagtgatgaacatggacctggaaacccggcggagcttcgctgttcagcagggccattaccaggatcctagagccagcgactacgacctgcctagagcctccgattatgatctgcctcggagcccctatcctacacctccactgccacctagataccagctccagaatatggacgtggaagccggattccgcgaggccgtgtatgctagctttgtggccggcatgtacaactacgtggtcacccagcctcaagagcggatccccaattctcagcaggtcgagggcatcctgagggacatgctgacaaatggcagccagaccttccgggacctgatgaagagatggaacagagaggtggacagagag

SEQ ID NO: 219 - DNA, 2547 bp, Artificial Sequence
  Synthetic Polynucleotide
atggaaacccctgctcagctgctgttcctgctgctgctgtggctgcctgatacaaccggcgagcctaagagctgcgacaagacccacacctgtcctccatgtcctgctccagaactgctcggcggaccttccgtgttcctgtttcctccaaagcctaaggacaccctgatgatcagcagaacccctgaagtgacctgcgtggtggtggatgtgtcccacgaggatcccgaagtgaagttcaattggtacgtggacggcgtggaagtgcacaacgccaagaccaagcctagagaggaacagtacaacagcacctacagagtggtgtccgtgctgaccgtgctgcaccaggattggctgaacggcaaagagtacaagtgcaaggtgtccaacaaggccctgcctgctcctatcgagaagaccatcagcaaggccaagggccagccaagagaaccccaggtgtacacactgcctccaagcagagatgagctgaccaagaaccaggtgtccctgacctgtctggtcaagggcttctacccctccgatatcgccgtggaatgggagagcaatggccagcctgagaacaactacaagacaacccctcctgtgctggacagcgacggctcattcttcctgtacagcaagctgacagtggacaagagcagatggcagcagggcaacgtgttcagctgcagcgtgatgcacgaggccctgcacaatcactacacccagaagtccctgtctctgagccccggcaagatgagcatcagaggcgttggcggcaacggcaacagcagaatccctagccataatggcgacggcagcaacaggcggagccagaataccaagggcaacaacaaggtggaagatcgcgtgtgcagcctgtactccagcagaagcaacgagaaccgcgagagcccttatgccgtggtcgacgtgtccagcatgatcgagagcacacctaccagcggcgagacaaccagagctagtagaggcgtgctgagccggtttcagagaggcctcgttcggatcgctgacaaagtgcggagagccgtgcagtgtgcctggtctagtgtgtccaccagcagatcctctgccacaagagccgccgagtctggcagctctagcagaacagctagaggcgccagcagcggctacagagagtattctccatctgccgccagaggcctgcggctgatgtttacagatttctggcggacccgggtgctgagacagacatctcctatggctggcgtgttcggcaacctggatgtgaatgaggccagactgatggccgcctacacaagcgaatgtgccgatcacctggaagccaaagagctggctggacctgacggtgttgccgccgctagagaaatcgccaagagatgggagaagagagtgcgggacctgcaggataagggcgctgctagaaagctgctgaacgaccctctgggcagaagaacccctaactaccagagcaagaaccccggcgagtacaccgtgggcaactccatgttctacgacggacctcaggtggccaacctgcagaatgtggataccggcttctggctggatatgagcaacctgagcgacgtggtgctgtccagagagatccagacaggcctgagagccagagccacactggaagagtccatgcctatgctcgagaacctggaagagagattccggcggctgcaagagacatgtgacgccgccagaaccgagatcgaggaaagcggctggaccagagaaagcgcctccagaatggaaggcgacgaagcccaaggacctagcagagtgcagcaggccttccagagcttcgtgaacgagtgcaacagcatcgagttcagcttcggctccttcggcgaacatgtgcgggtgctgtgtgccagagttagcagaggacttgctgccgctggcgaggccatcagaagatgcttctcttgctgcaagggcagcacccacagatacgcccctagagatgatctgagccctgagggcgcatctctggccgaaacactggccagattcgccgacgatatgggcattgaaagaggcgccgacggaacctacgacatccctctggtggacgattggagaaggggcgtgccatctatcgaaggcgagggcagcgatagcatctacgagatcatgatgcccatctacgaagtgatgaacatggacctggaaacccggcggagcttcgctgttcagcagggccattaccaggatcctagagccagcgactacgacctgcctagagcctccgattatgatctgcctcggagcccctatcctacacctccactgccacctagataccagctccagaatatggacgtggaagccggattccgcgaggccgtgtatgctagctttgtggccggcatgtacaactacgtggtcacccagcctcaagagcggatccccaattctcagcaggtcgagggcatcctgagggacatgctgacaaatggcagccagaccttccgggacctgatgaagagatggaacagagaggtggaccgcgagcaccaccaccatcaccat

SEQ ID NO: 220 - DNA, 561 bp, Artificial Sequence
  Synthetic Polynucleotide
atggaaacccctgctcagctgctgttcctgctgctgctgtggctgcctgataccaccggaatgagcagacagaacgccgaggagaacctgaagaacttcgccaaagagctgaagctgcccgacgtggccttcgaccagaacaatgcctgcatcctgttcgtggacggcgagttctctctgcacctgacctacgaggaacacagcgaccggctgtatgtgtacgcccctctgctggatggcctgcctgacaaccctcagagaaagctggccctgtacgagaagctgctggaaggctctatgctcggcggacaaatggctggtggcggagtgggagttgccaccaaagaacagctgatcctgatgcactgcgtgctggacatgaagtacgccgagactaacctgctgaaggctttcgcccagctgttcatcgagacagtggtcaagtggcggaccgtgtgcagcgatattagcgccggcagagaacccaccgtggacaccatgcctcaaatgccacaaggcggcggaggcggaattcaacctcctccagccggaattagagcc

SEQ ID NO: 221 - DNA, 579 bp, Artificial Sequence
  Synthetic Polynucleotide
atggaaacccctgctcagctgctgttcctgctgctgctgtggctgcctgataccaccggaatgagcagacagaacgccgaggagaacctgaagaacttcgccaaagagctgaagctgcccgacgtggccttcgaccagaacaatgcctgcatcctgttcgtggacggcgagttctctctgcacctgacctacgaggaacacagcgaccggctgtatgtgtacgcccctctgctggatggcctgcctgacaaccctcagagaaagctggccctgtacgagaagctgctggaaggctctatgctcggcggacaaatggctggtggcggagtgggagttgccaccaaagaacagctgatcctgatgcactgcgtgctggacatgaagtacgccgagactaacctgctgaaggctttcgcccagctgttcatcgagacagtggtcaagtggcggaccgtgtgcagcgatattagcgccggcagagaacccaccgtggacaccatgcctcaaatgccacaaggcggcggaggcggaattcaacctcctccagccggaatcagagcccaccaccatcaccatcat

SEQ ID NO: 222 - DNA, 561 bp, Artificial Sequence
  Synthetic Polynucleotide
atggaaacccctgctcagctgctgttcctgctgctgctgtggctgcctgataccaccggaatgagcagacagaacgccgaggagaacctgaagaacttcgccaaagagctgaagctgcccgacgtggccttcgaccagaacaatacctgcatcctgttcgtggacggcgagttcagcctgcacctgacctacgaggaacacagcgaccggctgtatgtgtacgcccctctgctggatggcctgcctgacaaccctcagagaaagctggccctgtacgagaagctgctggaaggctctatgctcggcggacaaatggctggtggcggagtgggagttgccaccaaagaacagctgatcctgatgcactgcgtgctggacatgaagtacgccgagactaacctgctgaaggctttcgcccagctgttcatcgagacagtggtcaagtggcggaccgtgtgcagcgatattagcgccggcagagaacccaccgtggacaccatgcctcaaatgccacaaggcggcggaggcggaattcaacctcctccagccggaattagagcc

SEQ ID NO: 223 - DNA, 579 bp, Artificial Sequence
  Synthetic Polynucleotide
atggaaacccctgctcagctgctgttcctgctgctgctgtggctgcctgataccaccggaatgagcagacagaacgccgaggagaacctgaagaacttcgccaaagagctgaagctgcccgacgtggccttcgaccagaacaatacctgcatcctgttcgtggacggcgagttcagcctgcacctgacctacgaggaacacagcgaccggctgtatgtgtacgcccctctgctggatggcctgcctgacaaccctcagagaaagctggccctgtacgagaagctgctggaaggctctatgctcggcggacaaatggctggtggcggagtgggagttgccaccaaagaacagctgatcctgatgcactgcgtgctggacatgaagtacgccgagactaacctgctgaaggctttcgcccagctgttcatcgagacagtggtcaagtggcggaccgtgtgcagcgatattagcgccggcagagaacccaccgtggacaccatgcctcaaatgccacaaggcggcggaggcggaattcaacctcctccagccggaatcagagcccaccaccatcaccatcat

SEQ ID NO: 224 - DNA, 3597 bp, Artificial Sequence
  Synthetic Polynucleotide
atggaaactcctgcccaactgttgttccttctgctgctctggttgcccgacaccaccggatcgtgcgtggatctccacgctggcggccagtccgtgaacgagcttgtgtacgtgggcccacaggccgtgcttctgctggaccagatcagagatctcttcgtgggttccaaggactcccaggccgagggacagtaccggctcatcgtcggcgacccttcaagcttccaagagaaggatgccgacactcttccggggaaggtggaacagtccactctgttttccgtgaccaacccagtcgtgtttcaaggggtggaccagcaggaccaggtgtccagccaaggactgatctgttcattcacctcgagcaatttggacagcccccgggacggcgaatcgttccttggcatcgcattcgtgggagactcatccaaagcaggaatcacccttaccgatgtgaaggcgtccctgagcggcgctgctctgtactccaccgaagatctcatcttcgagaagatcaagggtggactggagttcgccagctgctcctcactggaacagggaggagcctgtgccgcccaaagcatcctcatccacgattgccaggggctccaagtgaagcattgtaccactgccgtgaacgccgagggatcatccgctaacgatcacctcggtttcggagggggtgccttcttcgtgaccggttcgctgtcgggagagaagtcactgtatatgcccgcgggcgacatggtggtcgccaactgcgatggagccatctcattcgagggaaactccgccaacttcgcaaacggcggcgctatcgccgctagcgggaaggtgctgttcgtggctaacgacaagaagacgtccttcatcgagaaccgcgccctgtcgggaggtgccattgccgccagctccgacattgccttccagaactgtgcggaactggtgttcaaaggaaactgcgccatcggcaccgaagataagggaagcctgggaggcggcgccatttcctccctcggcaccgtgctgcttcagggaaaccacggcatcacttgtgacaagaacgaaagcgcgtcccaggggggagcgatcttcgggaagaactgccagatttccgacaacgagggaccggtggtgttcagagactccactgcctgcctgggcggcggagcgatcgcagcacaggaaattgtcagcatccagaacaaccaggccggcatcagcttcgaggggggaaaggcttcgttcggcggaggtattgcctgcggatcgttctcgtccgcgggcggagcctccgtgctcggaaccatcgacatttccaagaacctgggcgctatctcgttttctcgcaccctgtgcactacttccgacctgggtcagatggagtaccagggaggcggagcgctgtttggagagaacatctctctgagcgagaacgcgggagtgctgaccttcaaggacaacattgtgaagaccttcgcctcaaacggaaagatcctggggggaggcgccatcctggcaaccgggaaggtcgaaatcaccaacaattcagagggtatctccttcactggcaacgcccgggccccccaagccctgccgactcaggaagagttccccctgttctccaagaaggaaggacgccctttgtcatccggctactccggtggtggagcgattctgggtcgggaagtggccatcctgcataatgcggccgtggtgtttgagcagaacagactccaatgctccgaagaagaggccaccctcctggggtgctgcgggggcggagcagtgcatggcatggattccacttccatcgtgggaaactccagcgtccgcttcggaaacaactacgctatgggacagggagtgtcaggcggggccctgctgtccaagaccgtccagttggccggaaacggttcggtggatttctcacgcaatatcgcctcgctgggaggcggcgcgctgcaggcctccgaaggaaattgcgaactggtcgacaacggctacgtgctgttccgggacaaccgcggcagggtgtacggcggagcaatctcgtgccttcggggcgacgtcgtgatctcgggaaataagggacgggtcgagtttaaggacaacatcgctaccaggctctacgtggaggaaactgtggagaaggtggaggaagtggagcctgccccggaacagaaggacaacaacgagctgtcgttcctcggtcgggcagaacagtccttcattactgccgccaaccaggccctgttcgcgtccgaagatggtgacctcagcccggaatccagcatctcctccgaggaactggccaagcggagagaatgcgcgggaggcgcaatctttgcgaagcgggtccggatcgtggacaaccaggaagctgtggtgttcagcaacaacttttccgacatctacggtggtgcaattttcaccggctcactccgggaggaggacaagctggacggccagattcccgaggtgctcatttccggcaatgccggcgacgtggtgttctccggaaactcctccaagagggacgaacacctcccgcataccggaggaggagccatctgcactcagaacctgacgatctcgcagaacaccggcaatgtgctgttctacaacaacgtcgcatgttccggtggcgccgtcagaatcgaggaccacggaaacgtgctgctggaagcattcgggggtgatattgtgttcaagggaaacagcagcttccgggcccagggatcagatgcaatctacttcgccgggaaggagagccacattaccgccctgaacgccaccgagggtcacgccatcgtgttccacgatgccctggtgttcgagaacctggaggagcgcaagagcgccgaagtgctgcttatcaattcccgcgagaacccgggctacaccggatccatccggttcctcgaagcggagtcgaaggtcccgcagtgtattcatgtgcaacaggggtccctggaactgcttaacggagccaccctgtgctcctacggctttaagcaggacgcgggcgctaaactggtgctggcggccggcgccaagcttaagatcctcgactccggaaccccggtgcagcaggggcacgctattagcaagcctgaagccgagattgagtcgtcatccgaacccgaaggggcgcactccctgtggatagccaagaacgcgcagaccaccgtgccaatggtcgatatccacacaatctccgtggacctcgccagcttctcgtcgagccagcaggagggaactgtcgaagcgcctcaggtcatcgtgccgggaggttcctacgtgcgctcgggggagctcaacctggaactcgtgaataccactggaacgggatatgagaaccacgccctgctgaagaacgaagccaaagtgccactgatgtccttcgtcgcctccggcgacgaggcctccgccgagattagcaacctgtcggtgtcagatctgcaaattcacgtggtgacccctgagattgaggaggacacctacgggcacatgggcgattggtccgaggcgaagatccaggacggcacactggtcatttcatggaaccctaccggacatcaccaccaccatcac

SEQ ID NO: 225 - DNA, 3579 bp, Artificial Sequence
  Synthetic Polynucleotide
atggaaactcctgcccaactgttgttccttctgctgctctggttgcccgacaccaccggatcgtgcgtggatctccacgctggcggccagtccgtgaacgagcttgtgtacgtgggcccacaggccgtgcttctgctggaccagatcagagatctcttcgtgggttccaaggactcccaggccgagggacagtaccggctcatcgtcggcgacccttcaagcttccaagagaaggatgccgacactcttccggggaaggtggaacagtccactctgttttccgtgaccaacccagtcgtgtttcaaggggtggaccagcaggaccaggtgtccagccaaggactgatctgttcattcacctcgagcaatttggacagcccccgggacggcgaatcgttccttggcatcgcattcgtgggagactcatccaaagcaggaatcacccttaccgatgtgaaggcgtccctgagcggcgctgctctgtactccaccgaagatctcatcttcgagaagatcaagggtggactggagttcgccagctgctcctcactggaacagggaggagcctgtgccgcccaaagcatcctcatccacgattgccaggggctccaagtgaagcattgtaccactgccgtgaacgccgagggatcatccgctaacgatcacctcggtttcggagggggtgccttcttcgtgaccggttcgctgtcgggagagaagtcactgtatatgcccgcgggcgacatggtggtcgccaactgcgatggagccatctcattcgagggaaactccgccaacttcgcaaacggcggcgctatcgccgctagcgggaaggtgctgttcgtggctaacgacaagaagacgtccttcatcgagaaccgcgccctgtcgggaggtgccattgccgccagctccgacattgccttccagaactgtgcggaactggtgttcaaaggaaactgcgccatcggcaccgaagataagggaagcctgggaggcggcgccatttcctccctcggcaccgtgctgcttcagggaaaccacggcatcacttgtgacaagaacgaaagcgcgtcccaggggggagcgatcttcgggaagaactgccagatttccgacaacgagggaccggtggtgttcagagactccactgcctgcctgggcggcggagcgatcgcagcacaggaaattgtcagcatccagaacaaccaggccggcatcagcttcgaggggggaaaggcttcgttcggcggaggtattgcctgcggatcgttctcgtccgcgggcggagcctccgtgctcggaaccatcgacatttccaagaacctgggcgctatctcgttttctcgcaccctgtgcactacttccgacctgggtcagatggagtaccagggaggcggagcgctgtttggagagaacatctctctgagcgagaacgcgggagtgctgaccttcaaggacaacattgtgaagaccttcgcctcaaacggaaagatcctggggggaggcgccatcctggcaaccgggaaggtcgaaatcaccaacaattcagagggtatctccttcactggcaacgcccgggccccccaagccctgccgactcaggaagagttccccctgttctccaagaaggaaggacgccctttgtcatccggctactccggtggtggagcgattctgggtcgggaagtggccatcctgcataatgcggccgtggtgtttgagcagaacagactccaatgctccgaagaagaggccaccctcctggggtgctgcgggggcggagcagtgcatggcatggattccacttccatcgtgggaaactccagcgtccgcttcggaaacaactacgctatgggacagggagtgtcaggcggggccctgctgtccaagaccgtccagttggccggaaacggttcggtggatttctcacgcaatatcgcctcgctgggaggcggcgcgctgcaggcctccgaaggaaattgcgaactggtcgacaacggctacgtgctgttccgggacaaccgcggcagggtgtacggcggagcaatctcgtgccttcggggcgacgtcgtgatctcgggaaataagggacgggtcgagtttaaggacaacatcgctaccaggctctacgtggaggaaactgtggagaaggtggaggaagtggagcctgccccggaacagaaggacaacaacgagctgtcgttcctcggtcgggcagaacagtccttcattactgccgccaaccaggccctgttcgcgtccgaagatggtgacctcagcccggaatccagcatctcctccgaggaactggccaagcggagagaatgcgcgggaggcgcaatctttgcgaagcgggtccggatcgtggacaaccaggaagctgtggtgttcagcaacaacttttccgacatctacggtggtgcaattttcaccggctcactccgggaggaggacaagctggacggccagattcccgaggtgctcatttccggcaatgccggcgacgtggtgttctccggaaactcctccaagagggacgaacacctcccgcataccggaggaggagccatctgcactcagaacctgacgatctcgcagaacaccggcaatgtgctgttctacaacaacgtcgcatgttccggtggcgccgtcagaatcgaggaccacggaaacgtgctgctggaagcattcgggggtgatattgtgttcaagggaaacagcagcttccgggcccagggatcagatgcaatctacttcgccgggaaggagagccacattaccgccctgaacgccaccgagggtcacgccatcgtgttccacgatgccctggtgttcgagaacctggaggagcgcaagagcgccgaagtgctgcttatcaattcccgcgagaacccgggctacaccggatccatccggttcctcgaagcggagtcgaaggtcccgcagtgtattcatgtgcaacaggggtccctggaactgcttaacggagccaccctgtgctcctacggctttaagcaggacgcgggcgctaaactggtgctggcggccggcgccaagcttaagatcctcgactccggaaccccggtgcagcaggggcacgctattagcaagcctgaagccgagattgagtcgtcatccgaacccgaaggggcgcactccctgtggatagccaagaacgcgcagaccaccgtgccaatggtcgatatccacacaatctccgtggacctcgccagcttctcgtcgagccagcaggagggaactgtcgaagcgcctcaggtcatcgtgccgggaggttcctacgtgcgctcgggggagctcaacctggaactcgtgaataccactggaacgggatatgagaaccacgccctgctgaagaacgaagccaaagtgccactgatgtccttcgtcgcctccggcgacgaggcctccgccgagattagcaacctgtcggtgtcagatctgcaaattcacgtggtgacccctgagattgaggaggacacctacgggcacatgggcgattggtccgaggcgaagatccaggacggcacactggtcatttcatggaaccctaccgga

SEQ ID NO: 226 - DNA, 3579 bp, Artificial Sequence
  Synthetic Polynucleotide
atggaaactcctgcccaactgttgttccttctgctgctctggttgcccgacaccaccggatcgtgcgtggatctccacgctggcggccagtccgtgaacgagcttgtgtacgtgggcccacaggccgtgcttctgctggaccagatcagagatctcttcgtgggttccaaggactcccaggccgagggacagtaccggctcatcgtcggcgacccttcaagcttccaagagaaggatgccgacactcttccggggaaggtggaacagtccactctgttttccgtgaccaacccagtcgtgtttcaaggggtggaccagcaggaccaggtgtccagccaaggactgatctgttcattcacctcgagcaatttggacagcccccgggacggcgaatcgttccttggcatcgcattcgtgggagactcatccaaagcaggaatcacccttaccgatgtgaaggcgtccctgagcggcgctgctctgtactccaccgaagatctcatcttcgagaagatcaagggtggactggagttcgccagctgctcctcactggaacagggaggagcctgtgccgcccaaagcatcctcatccacgattgccaggggctccaagtgaagcattgtaccactgccgtgaacgccgagggatcatccgctaacgatcacctcggtttcggagggggtgccttcttcgtgaccggttcgctgtcgggagagaagtcactgtatatgcccgcgggcgacatggtggtcgccaactgcgatggagccatctcattcgagggaaactccgccaacttcgcaaacggcggcgctatcgccgctagcgggaaggtgctgttcgtggctaacgacaagaagacgtccttcatcgagaaccgcgccctgtcgggaggtgccattgccgccagctccgacattgccttccagaactgtgcggaactggtgttcaaaggaaactgcgccatcggcaccgaagataagggaagcctgggaggcggcgccatttcctccctcggcaccgtgctgcttcagggaaaccacggcatcacttgtgacaagaacgaagcagcgtcccaggggggagcgatcttcgggaagaactgccagatttccgacaacgagggaccggtggtgttcagagactccactgcctgcctgggcggcggagcgatcgcagcacaggaaattgtcagcatccagaacaaccaggccggcatcagcttcgaggggggaaaggcttcgttcggcggaggtattgcctgcggatcgttctcgtccgcgggcggagcctccgtgctcggaaccatcgacatttccaagaacctgggcgctatctcgttttctcgcaccctgtgcactacttccgacctgggtcagatggagtaccagggaggcggagcgctgtttggagagaacatcgctctgagcgagaacgcgggagtgctgaccttcaaggacaacattgtgaagaccttcgcctcaaacggaaagatcctggggggaggcgccatcctggcaaccgggaaggtcgaaatcaccaacaatgcagagggtatctccttcactggcaacgcccgggccccccaagccctgccgactcaggaagagttccccctgttctccaagaaggaaggacgccctttgtcatccggctactccggtggtggagcgattctgggtcgggaagtggccatcctgcataatgcggccgtggtgtttgagcagaacagactccaatgctccgaagaagaggccaccctcctggggtgctgcgggggcggagcagtgcatggcatggattccacttccatcgtgggaaactccgcagtccgcttcggaaacaactacgctatgggacagggagtgtcaggcggggccctgctgtccaagaccgtccagttggccggaaacggtgcggtggatttctcacgcaatatcgcctcgctgggaggcggcgcgctgcaggcctccgaaggaaattgcgaactggtcgacaacggctacgtgctgttccgggacaaccgcggcagggtgtacggcggagcaatctcgtgccttcggggcgacgtcgtgatctcgggaaataagggacgggtcgagtttaaggacaacatcgctaccaggctctacgtggaggaaactgtggagaaggtggaggaagtggagcctgccccggaacagaaggacaacaacgagctgtcgttcctcggtcgggcagaacagtccttcattactgccgccaaccaggccctgttcgcgtccgaagatggtgacctcagcccggaatccagcatctcctccgaggaactggccaagcggagagaatgcgcgggaggcgcaatctttgcgaagcgggtccggatcgtggacaaccaggaagctgtggtgttcagcaacaactttgccgacatctacggtggtgcaattttcaccggctcactccgggaggaggacaagctggacggccagattcccgaggtgctcatttccggcaatgccggcgacgtggtgttctccggaaactccgccaagagggacgaacacctcccgcataccggaggaggagccatctgcactcagaacctggcaatctcgcagaacaccggcaatgtgctgttctacaacaacgtcgcatgttccggtggcgccgtcagaatcgaggaccacggaaacgtgctgctggaagcattcgggggtgatattgtgttcaagggaaacagcgcattccgggcccagggatcagatgcaatctacttcgccgggaaggagagccacattaccgccctgaacgccgccgagggtcacgccatcgtgttccacgatgccctggtgttcgagaacctggaggagcgcaagagcgccgaagtgctgcttatcaattcccgcgagaacccgggctacaccggatccatccggttcctcgaagcggagtcgaaggtcccgcagtgtattcatgtgcaacaggggtccctggaactgcttaacggagccaccctgtgctcctacggctttaagcaggacgcgggcgctaaactggtgctggcggccggcgccaagcttaagatcctcgactccggaaccccggtgcagcaggggcacgctattagcaagcctgaagccgagattgagtcgtcatccgaacccgaaggggcgcactccctgtggatagccaagaacgcgcagaccaccgtgccaatggtcgatatccacacaatctccgtggacctcgccagcttctcgtcgagccagcaggagggaactgtcgaagcgcctcaggtcatcgtgccgggaggttcctacgtgcgctcgggggagctcaacctggaactcgtgaataccgctggaacgggatatgagaaccacgccctgctgaagaacgaagccaaagtgccactgatgtccttcgtcgcctccggcgacgaggcctccgccgagattagcaacctggcggtgtcagatctgcaaattcacgtggtgacccctgagattgaggaggacacctacgggcacatgggcgattggtccgaggcgaagatccaggacggcacactggtcatttcatggaaccctgccgga

SEQ ID NO: 227 - DNA, 3597 bp, Artificial Sequence
  Synthetic Polynucleotide
atggaaactcctgcccaactgttgttccttctgctgctctggttgcccgacaccaccggatcgtgcgtggatctccacgctggcggccagtccgtgaacgagcttgtgtacgtgggcccacaggccgtgcttctgctggaccagatcagagatctcttcgtgggttccaaggactcccaggccgagggacagtaccggctcatcgtcggcgacccttcaagcttccaagagaaggatgccgacactcttccggggaaggtggaacagtccactctgttttccgtgaccaacccagtcgtgtttcaaggggtggaccagcaggaccaggtgtccagccaaggactgatctgttcattcacctcgagcaatttggacagcccccgggacggcgaatcgttccttggcatcgcattcgtgggagactcatccaaagcaggaatcacccttaccgatgtgaaggcgtccctgagcggcgctgctctgtactccaccgaagatctcatcttcgagaagatcaagggtggactggagttcgccagctgctcctcactggaacagggaggagcctgtgccgcccaaagcatcctcatccacgattgccaggggctccaagtgaagcattgtaccactgccgtgaacgccgagggatcatccgctaacgatcacctcggtttcggagggggtgccttcttcgtgaccggttcgctgtcgggagagaagtcactgtatatgcccgcgggcgacatggtggtcgccaactgcgatggagccatctcattcgagggaaactccgccaacttcgcaaacggcggcgctatcgccgctagcgggaaggtgctgttcgtggctaacgacaagaagacgtccttcatcgagaaccgcgccctgtcgggaggtgccattgccgccagctccgacattgccttccagaactgtgcggaactggtgttcaaaggaaactgcgccatcggcaccgaagataagggaagcctgggaggcggcgccatttcctccctcggcaccgtgctgcttcagggaaaccacggcatcacttgtgacaagaacgaagcagcgtcccaggggggagcgatcttcgggaagaactgccagatttccgacaacgagggaccggtggtgttcagagactccactgcctgcctgggcggcggagcgatcgcagcacaggaaattgtcagcatccagaacaaccaggccggcatcagcttcgaggggggaaaggcttcgttcggcggaggtattgcctgcggatcgttctcgtccgcgggcggagcctccgtgctcggaaccatcgacatttccaagaacctgggcgctatctcgttttctcgcaccctgtgcactacttccgacctgggtcagatggagtaccagggaggcggagcgctgtttggagagaacatcgctctgagcgagaacgcgggagtgctgaccttcaaggacaacattgtgaagaccttcgcctcaaacggaaagatcctggggggaggcgccatcctggcaaccgggaaggtcgaaatcaccaacaatgcagagggtatctccttcactggcaacgcccgggccccccaagccctgccgactcaggaagagttccccctgttctccaagaaggaaggacgccctttgtcatccggctactccggtggtggagcgattctgggtcgggaagtggccatcctgcataatgcggccgtggtgtttgagcagaacagactccaatgctccgaagaagaggccaccctcctggggtgctgcgggggcggagcagtgcatggcatggattccacttccatcgtgggaaactccgcagtccgcttcggaaacaactacgctatgggacagggagtgtcaggcggggccctgctgtccaagaccgtccagttggccggaaacggtgcggtggatttctcacgcaatatcgcctcgctgggaggcggcgcgctgcaggcctccgaaggaaattgcgaactggtcgacaacggctacgtgctgttccgggacaaccgcggcagggtgtacggcggagcaatctcgtgccttcggggcgacgtcgtgatctcgggaaataagggacgggtcgagtttaaggacaacatcgctaccaggctctacgtggaggaaactgtggagaaggtggaggaagtggagcctgccccggaacagaaggacaacaacgagctgtcgttcctcggtcgggcagaacagtccttcattactgccgccaaccaggccctgttcgcgtccgaagatggtgacctcagcccggaatccagcatctcctccgaggaactggccaagcggagagaatgcgcgggaggcgcaatctttgcgaagcgggtccggatcgtggacaaccaggaagctgtggtgttcagcaacaactttgccgacatctacggtggtgcaattttcaccggctcactccgggaggaggacaagctggacggccagattcccgaggtgctcatttccggcaatgccggcgacgtggtgttctccggaaactccgccaagagggacgaacacctcccgcataccggaggaggagccatctgcactcagaacctggcaatctcgcagaacaccggcaatgtgctgttctacaacaacgtcgcatgttccggtggcgccgtcagaatcgaggaccacggaaacgtgctgctggaagcattcgggggtgatattgtgttcaagggaaacagcgcattccgggcccagggatcagatgcaatctacttcgccgggaaggagagccacattaccgccctgaacgccgccgagggtcacgccatcgtgttccacgatgccctggtgttcgagaacctggaggagcgcaagagcgccgaagtgctgcttatcaattcccgcgagaacccgggctacaccggatccatccggttcctcgaagcggagtcgaaggtcccgcagtgtattcatgtgcaacaggggtccctggaactgcttaacggagccaccctgtgctcctacggctttaagcaggacgcgggcgctaaactggtgctggcggccggcgccaagcttaagatcctcgactccggaaccccggtgcagcaggggcacgctattagcaagcctgaagccgagattgagtcgtcatccgaacccgaaggggcgcactccctgtggatagccaagaacgcgcagaccaccgtgccaatggtcgatatccacacaatctccgtggacctcgccagcttctcgtcgagccagcaggagggaactgtcgaagcgcctcaggtcatcgtgccgggaggttcctacgtgcgctcgggggagctcaacctggaactcgtgaataccgctggaacgggatatgagaaccacgccctgctgaagaacgaagccaaagtgccactgatgtccttcgtcgcctccggcgacgaggcctccgccgagattagcaacctggcggtgtcagatctgcaaattcacgtggtgacccctgagattgaggaggacacctacgggcacatgggcgattggtccgaggcgaagatccaggacggcacactggtcatttcatggaaccctgccggacatcaccaccaccatcac

SEQ ID NO: 228 - DNA, 2070 bp, Artificial Sequence
  Synthetic Polynucleotide
atggaaacccctgctcagctgctgttcctgctgctgctgtggctgcctgatacaacaggcgccgagatcatgattccccagggcatctacgacggcgaaaccctgaccgtgtctttcccctataccgtgatcggcgatcctagcggcaccaccgtgttttctgctggcgagctgaccctgaagaacctggacaactctatcgccgctctgcccctgagctgcttcggaaatctgctgggcagcttcaccgtgctcggcagaggacacagcctgaccttcgagaacatccggaccagcacaaatggcgctgccctgagcgatagcgccaatagcggcctgtttaccatcgagggcttcaaagagctgagcttcagcaactgcaacagcctgctggcagtgctgcctgccgccacaacaaatagcggcagccagacacctaccaccaccagcacaccttctaacggcgccatctacagcaagaccgacctgctgctcctgaacaacgagaagttcagcttctactccaacctggtgtccggcgacggcggagccattgatgccaaatctctgaccgtgcagggcatcagcaagctgtgcgtgttccaagagaacacagcccaggctgatggcggagcctgtcaggtggtcacaagctttagcgccatggccaacgaggcccctatcgcctttattgccaatgtggccggcgttagaggcggaggaattgccgctgttcaggatggacagcagggcgtgtccagcagcacaagcactgaggatcctgtggtgtccttcagcagaaacaccgccgtggaattcgatggcaacgtggccagagttggcggcggaatctacagctacggaaacgtggcctttctgaacaatggcaagaccctgttcctcaacaacgtggcaagccccgtgtatatcgccgccgagcagcctacaaatggccaggcctctaataccgccgacaactatggcgacggtggcgcaatcttctgcaagaatggtgctcaggccgctggcagcaacaatgccggctctgtgtcctttgatggcgaaggcgtggtgttcttctcctctaacgtggccgctggaaaaggcggcgctatctacgccaagaaactgagcgtggccaactgcggccctgtgcagtttctgggcaatatcgccaatgatggcggtgccatctacctgggagagtccggcgaactgtctctgagcgccgattacggcgacatcatcttcgacggcaacctgaagcggaccgccaaagaaaatgccgccgatgtgaatggcgtgacagtgtccagccaggccatctctatgggctctggcggcaagatcaccacactgagagccaaggccggccaccagatcctgttcaacgaccctatcgagatggccaatggcaacaaccagcctgctcagagcagcgagcccctgaagattaacgatggcgagggctacaccggcgatatcgtgttcgccaacggcaacagcgccctgtaccagaatgtggccatcgagcagggcagaatcgtgctgagagagaaggccaagctgagcgtgaacagcctgagtcagacaggcggcagcctgtatatggaagccggcagcaccctggacttcgtgacacctcaacctccacagcaacctccagccgccaaccagctgatcaccctgtctaatctgcacctgagcctgagttccctgctggccaacaacgccgtgaccaatcctcctaccaatccaccagctcaggactctcaccctgccatcatcggctctacaacagccggaagcgtgacaatcagcggccccatcttcttcgaggacctggacgataccgcctacgacagatacgattggctgggctccaaccagaaaatcgacgtgctgaaactgcagctgggcacccagccatctgccaacgctccatctgatctgaccctgggcaacgagatgcctaagtacggctaccaaggcagctggaagctggcctgggatcctaacacagccaacaatggcccctacacactgaaggccacctggaccaagacaggc

SEQ ID NO: 229 - DNA, 2088 bp, Artificial Sequence
  Synthetic Polynucleotide
atggaaacccctgctcagctgctgttcctgctgctgctgtggctgcctgatacaacaggcgccgagatcatgattccccagggcatctacgacggcgaaaccctgaccgtgtctttcccctataccgtgatcggcgatcctagcggcaccaccgtgttttctgctggcgagctgaccctgaagaacctggacaactctatcgccgctctgcccctgagctgcttcggaaatctgctgggcagcttcaccgtgctcggcagaggacacagcctgaccttcgagaacatccggaccagcacaaatggcgctgccctgagcgatagcgccaatagcggcctgtttaccatcgagggcttcaaagagctgagcttcagcaactgcaacagcctgctggcagtgctgcctgccgccacaacaaatagcggcagccagacacctaccaccaccagcacaccttctaacggcgccatctacagcaagaccgacctgctgctcctgaacaacgagaagttcagcttctactccaacctggtgtccggcgacggcggagccattgatgccaaatctctgaccgtgcagggcatcagcaagctgtgcgtgttccaagagaacacagcccaggctgatggcggagcctgtcaggtggtcacaagctttagcgccatggccaacgaggcccctatcgcctttattgccaatgtggccggcgttagaggcggaggaattgccgctgttcaggatggacagcagggcgtgtccagcagcacaagcactgaggatcctgtggtgtccttcagcagaaacaccgccgtggaattcgatggcaacgtggccagagttggcggcggaatctacagctacggaaacgtggcctttctgaacaatggcaagaccctgttcctcaacaacgtggcaagccccgtgtatatcgccgccgagcagcctacaaatggccaggcctctaataccgccgacaactatggcgacggtggcgcaatcttctgcaagaatggtgctcaggccgctggcagcaacaatgccggctctgtgtcctttgatggcgaaggcgtggtgttcttctcctctaacgtggccgctggaaaaggcggcgctatctacgccaagaaactgagcgtggccaactgcggccctgtgcagtttctgggcaatatcgccaatgatggcggtgccatctacctgggagagtccggcgaactgtctctgagcgccgattacggcgacatcatcttcgacggcaacctgaagcggaccgccaaagaaaatgccgccgatgtgaatggcgtgacagtgtccagccaggccatctctatgggctctggcggcaagatcaccacactgagagccaaggccggccaccagatcctgttcaacgaccctatcgagatggccaatggcaacaaccagcctgctcagagcagcgagcccctgaagattaacgatggcgagggctacaccggcgatatcgtgttcgccaacggcaacagcgccctgtaccagaatgtggccatcgagcagggcagaatcgtgctgagagagaaggccaagctgagcgtgaacagcctgagtcagacaggcggcagcctgtatatggaagccggcagcaccctggacttcgtgacacctcaacctccacagcaacctccagccgccaaccagctgatcaccctgtctaatctgcacctgagcctgagttccctgctggccaacaacgccgtgaccaatcctcctaccaatccaccagctcaggactctcaccctgccatcatcggctctacaacagccggaagcgtgacaatcagcggccccatcttcttcgaggacctggacgataccgcctacgacagatacgattggctgggctccaaccagaaaatcgacgtgctgaaactgcagctgggcacccagccatctgccaacgctccatctgatctgaccctgggcaacgagatgcctaagtacggctaccaaggcagctggaagctggcctgggatcctaacacagccaacaatggcccctacacactgaaggccacctggaccaagacaggccaccaccatcaccatcac

SEQ ID NO: 230 - DNA, 318 bp, Artificial Sequence
  Synthetic Polynucleotide
atggaaacccctgctcagctgctgttcctgctgctgctgtggctgcctgataccacaggcatgagccagaacaagaacagcgccttcatgcagcccgtgaacgtggcagctgatctggccgctatagttggcgctggccctatgcctagaaccgagatcatcaagaagatgtgggactacattaagaagaacggcctgcaggaccccaccaacaagcggaacatcaaccccgacgacaagctggccaaggtgttcggcacagagaagcccatcgacatgttccagatgaccaagatggtgtcccagcacatcatcaag

SEQ ID NO: 231 - DNA, 336 bp, Artificial Sequence
  Synthetic Polynucleotide
atggaaacccctgctcagctgctgttcctgctgctgctgtggctgcctgataccacaggcatgagccagaacaagaacagcgccttcatgcagcccgtgaacgtggcagctgatctggccgctatagttggcgctggccctatgcctagaaccgagatcatcaagaagatgtgggactacattaagaagaacggcctgcaggaccccaccaacaagcggaacatcaaccccgacgacaagctggccaaggtgttcggcacagagaagcccatcgacatgttccagatgaccaagatggtgtcccagcacatcatcaagcaccaccaccatcaccac

SEQ ID NO: 232 - DNA, 1833 bp, Artificial Sequence
  Synthetic Polynucleotide
atggaaacccctgcccagctgctgttcctgctgctgctgtggctgcctgacaccaccggcatgagcatcagaggcgtgggcggcaacggcaacagcagaatccctagccacaacggcgacggcagcaacaggcggagccagaacaccaagggcaacaacaaggtggaagatagagtgtgcagcctgtacagcagccggtccaacgagaaccgcgagagcccttatgccgtggtggacgtgtccagcatgatcgagagcacccccaccagcggcgagacaaccagagctagtagaggcgtgctgagccggttccagaggggcctcgtgcggattgctgacaaagtgcggagagccgtgcagtgcgcttggagcagcgtgtccacaagcagaagcagcgccacaagagccgccgagagcggcagctctagcagaacagctagaggcgccagcagcggctacagagagtacagcccttctgccgctcggggcctgcggctgatgttcaccgacttttggcggacccgggtgctgagacagacctctcctatggccggcgtgttcggcaacctggacgtgaacgaggccagactgatggccgcctacaccagcgagtgtgccgatcacctggaagccaaagagctggccggacctgacggcgtggcagccgctagagaaatcgccaagagatgggagaagagagtgcgggacctgcaggacaagggcgctgccagaaagctgctgaacgaccccctgggcagacggacccccaactaccagagcaagaaccccggcgagtacaccgtgggcaactccatgttctacgacggcccccaggtggccaacctgcagaatgtggataccggcttctggctggacatgcagcacctgagcgacgtggtgctgtccagagagatccagaccggcctgagagccagagccaccctggaagagtccatgcccatgctggaaaatctggaagagagattccggcggctgcaggaaacctgcgacgccgccagaaccgagatcgaggaaagcggctggacccgggaaagcgcctccagaatggaaggcgacgaagcccagggccccagcagagtgcagcaggcctttcagagcttcgtgaatgagtgcaacagcatcgagttcagcttcggctccttcggcgagcacgtgcgggtgctgtgtgccagagtgtcaagaggactggccgctgccggcgaggccatcagaagatgcttcagctgctgcaagggcagcacccacagatacgcccccagagatgacctgtctcctgagggcgcctctctggccgaaaccctggccagattcgccgacgacatgggcatcgaaagaggcgccgacggcacctacgacatccccctggtggacgattggagaaggggcgtgccatccatcgagggcgagggcagcgatagcatctacgagatcatgatgcccatctacgaagtgatgaacatggacctggaaacccggcggagcttcgccgtgcagcagggccattaccaggaccccagagccagcgactacgacctgcctagagcctccgattacgatctgcccagaagcccctaccccacccctccactgcctcccagataccagctgcagaacatggatgtggaagccggctttcgcgaggccgtgtacgcctcttttgtggccggcatgtacaactacgtcgtgacccagccccaggaacggatccccaatagccagcaggtggaaggcatcctgcgggacatgctgaccaacggcgatcagaccttccgggacctgatgaagcggtggaacagagaggtggaccgcgag

SEQ ID NO: 233 - DNA, 1851 bp, Artificial Sequence
  Synthetic Polynucleotide
atggaaacccctgcccagctgctgttcctgctgctgctgtggctgcctgacaccaccggcatgagcatcagaggcgtgggcggcaacggcaacagcagaatccctagccacaacggcgacggcagcaacaggcggagccagaacaccaagggcaacaacaaggtggaagatagagtgtgcagcctgtacagcagccggtccaacgagaaccgcgagagcccttatgccgtggtggacgtgtccagcatgatcgagagcacccccaccagcggcgagacaaccagagctagtagaggcgtgctgagccggttccagaggggcctcgtgcggattgctgacaaagtgcggagagccgtgcagtgcgcttggagcagcgtgtccacaagcagaagcagcgccacaagagccgccgagagcggcagctctagcagaacagctagaggcgccagcagcggctacagagagtacagcccttctgccgctcggggcctgcggctgatgttcaccgacttttggcggacccgggtgctgagacagacctctcctatggccggcgtgttcggcaacctggacgtgaacgaggccagactgatggccgcctacaccagcgagtgtgccgatcacctggaagccaaagagctggccggacctgacggcgtggcagccgctagagaaatcgccaagagatgggagaagagagtgcgggacctgcaggacaagggcgctgccagaaagctgctgaacgaccccctgggcagacggacccccaactaccagagcaagaaccccggcgagtacaccgtgggcaactccatgttctacgacggcccccaggtggccaacctgcagaatgtggataccggcttctggctggacatgcagcacctgagcgacgtggtgctgtccagagagatccagaccggcctgagagccagagccaccctggaagagtccatgcccatgctggaaaatctggaagagagattccggcggctgcaggaaacctgcgacgccgccagaaccgagatcgaggaaagcggctggacccgggaaagcgcctccagaatggaaggcgacgaagcccagggccccagcagagtgcagcaggcctttcagagcttcgtgaatgagtgcaacagcatcgagttcagcttcggctccttcggcgagcacgtgcgggtgctgtgtgccagagtgtcaagaggactggccgctgccggcgaggccatcagaagatgcttcagctgctgcaagggcagcacccacagatacgcccccagagatgacctgtctcctgagggcgcctctctggccgaaaccctggccagattcgccgacgacatgggcatcgaaagaggcgccgacggcacctacgacatccccctggtggacgattggagaaggggcgtgccatccatcgagggcgagggcagcgatagcatctacgagatcatgatgcccatctacgaagtgatgaacatggacctggaaacccggcggagcttcgccgtgcagcagggccattaccaggaccccagagccagcgactacgacctgcctagagcctccgattacgatctgcccagaagcccctaccccacccctccactgcctcccagataccagctgcagaacatggatgtggaagccggctttcgcgaggccgtgtacgcctcttttgtggccggcatgtacaactacgtcgtgacccagccccaggaacggatccccaatagccagcaggtggaaggcatcctgcgggacatgctgaccaacggcgatcagaccttccgggacctgatgaagcggtggaacagagaggtggaccgcgagcaccaccatcaccaccac

SEQ ID NO: 234 - DNA, 2019 bp, Artificial Sequence
  Synthetic Polynucleotide
atggaaacccctgcccaactgcttttcttgctgctgctctggctccctgacaccaccggaatggaatctggacccgagtccgtgtcaagcaaccagaactccatgaaccccatcattaatggacagatcgcatccaattccgaaaccaaggaaagcaccaaggcatcggaggcctccccatccgcctcaagctccgtgtcgtcctggtcgtttctgtcgagcgcgaagaatgccctgatctcactgcgggacgcgattctgaacaagaacagctccccaaccgactccctgagccaactcgaggcctcaacttccacttcgactgtgactagggtcgctgccaaggattatgacgaggccaagagcaacttcgacaccgccaagagcggactggaaaacgccaaaaccctggccgaatacgaaactaagatggccgatctcatggcggccctgcaagacatggaacggctggcgaactccgatccgtccaacaaccacactgaggaagtgaacaacatcaagaaggctctcgaggcccagaaggataccatcgacaagttgaacaagcttgtgacgctgcagaaccaaaacaaggccctgacggaagtgctcaaaaccaccgactcggccgaccagattccggccatcaacagccagctggagattaacaagaactcggccgatcagattatcaaggacctggagcgccagaacattaactacgaggccgtcttgactaacgccggcgaagtgatcaaggcgtcatccgaagccggcattaagctgggacaggcgctgcaatccatcgtcgacgccggcgaccagtcccaggcggcggtgctgcaggcccagcagaacaactcccccgataacatcgctgcaaccaaggaactgattgacgcggccgaaaccaaagtcaacgaactgaagcaggagcacactggtctgaccgactcgccgctcgtgaagaaggccgaagaacagatcagccaggctcagaaggatatccaggaaatcaagccttcggggagcgacatcccgatcgtgggaccgtccggttccgccgcttccgccgggtccgcagccggggcccttaagtcgtcgaacaatagcggcagaatatccctgctgctcgacgatgtggataacgagatggccgccattgcgctgcaaggattccggtccatgatcgagcagttcaacgtgaacaaccccgccaccgccaaggagctgcaggctatggaggcccaactcactgccatgtccgaccagctcgtgggagcggacggagaactgccagccgagatccaggccatcaaggacgctctggcccaggcactgaagcagccgtccgcggatggcctggccaccgccatgggccaggtcgcgttcgccgccgctaaagtcggcggaggttcggccggcactgccgggaccgtgcagatgaatgtcaagcagctgtacaagactgcgttctcgtcgaccagctccagctcctacgccgcggccctgtccgacggttacagcgcgtacaagaccctgaactccctttactccgaatcgagatccggggtccagtccgcaatttcacaaaccgccaatcctgccctgtcgcgctcagtgtcacgcagcggcatcgagtcacagggcagaagcgccgacgctagccaaagggccgcagaaaccattgtgcgggactcccagacacttggagatgtctacagccgcctccaagtgctggactccctcatgtccaccatcgtgtcaaaccctcaggctaaccaggaggaaatcatgcagaagctgaccgcaagcatttccaaggctccgcagtttggataccccgctgtgcaaaactccgcggacagcttgcagaaattcgcagcccagttggagagggagttcgtggacggggagcggtccctcgcggagtcccaggagaacgcattccggaagcagcccgccttcattcaacaagtgcttgtgaacatcgcctccctgttctccggttacctgtct

SEQ ID NO: 235 - DNA, 2037 bp, Artificial Sequence
  Synthetic Polynucleotide
atggaaacccctgcccaactgcttttcttgctgctgctctggctccctgacaccaccggaatggaatctggacccgagtccgtgtcaagcaaccagaactccatgaaccccatcattaatggacagatcgcatccaattccgaaaccaaggaaagcaccaaggcatcggaggcctccccatccgcctcaagctccgtgtcgtcctggtcgtttctgtcgagcgcgaagaatgccctgatctcactgcgggacgcgattctgaacaagaacagctccccaaccgactccctgagccaactcgaggcctcaacttccacttcgactgtgactagggtcgctgccaaggattatgacgaggccaagagcaacttcgacaccgccaagagcggactggaaaacgccaaaaccctggccgaatacgaaactaagatggccgatctcatggcggccctgcaagacatggaacggctggcgaactccgatccgtccaacaaccacactgaggaagtgaacaacatcaagaaggctctcgaggcccagaaggataccatcgacaagttgaacaagcttgtgacgctgcagaaccaaaacaaggccctgacggaagtgctcaaaaccaccgactcggccgaccagattccggccatcaacagccagctggagattaacaagaactcggccgatcagattatcaaggacctggagcgccagaacattaactacgaggccgtcttgactaacgccggcgaagtgatcaaggcgtcatccgaagccggcattaagctgggacaggcgctgcaatccatcgtcgacgccggcgaccagtcccaggcggcggtgctgcaggcccagcagaacaactcccccgataacatcgctgcaaccaaggaactgattgacgcggccgaaaccaaagtcaacgaactgaagcaggagcacactggtctgaccgactcgccgctcgtgaagaaggccgaagaacagatcagccaggctcagaaggatatccaggaaatcaagccttcggggagcgacatcccgatcgtgggaccgtccggttccgccgcttccgccgggtccgcagccggggcccttaagtcgtcgaacaatagcggcagaatatccctgctgctcgacgatgtggataacgagatggccgccattgcgctgcaaggattccggtccatgatcgagcagttcaacgtgaacaaccccgccaccgccaaggagctgcaggctatggaggcccaactcactgccatgtccgaccagctcgtgggagcggacggagaactgccagccgagatccaggccatcaaggacgctctggcccaggcactgaagcagccgtccgcggatggcctggccaccgccatgggccaggtcgcgttcgccgccgctaaagtcggcggaggttcggccggcactgccgggaccgtgcagatgaatgtcaagcagctgtacaagactgcgttctcgtcgaccagctccagctcctacgccgcggccctgtccgacggttacagcgcgtacaagaccctgaactccctttactccgaatcgagatccggggtccagtccgcaatttcacaaaccgccaatcctgccctgtcgcgctcagtgtcacgcagcggcatcgagtcacagggcagaagcgccgacgctagccaaagggccgcagaaaccattgtgcgggactcccagacacttggagatgtctacagccgcctccaagtgctggactccctcatgtccaccatcgtgtcaaaccctcaggctaaccaggaggaaatcatgcagaagctgaccgcaagcatttccaaggctccgcagtttggataccccgctgtgcaaaactccgcggacagcttgcagaaattcgcagcccagttggagagggagttcgtggacggggagcggtccctcgcggagtcccaggagaacgcattccggaagcagcccgccttcattcaacaagtgcttgtgaacatcgcctccctgttctccggttacctgtctcatcaccaccaccatcac

SEQ ID NO: 236 - DNA, 408 bp, Artificial Sequence
  Synthetic Polynucleotide
atggaaacccctgcccagctgctgttcctgctgctgctgtggctgcctgataccaccggccctagcagcacccaggacaacagatccatggaccagcaggacagcgaggaatttctgctgcagaacaccctggaagatagcgagatcatcagcatccccgacaccatgaaccagatcgccatcgacaccgagaagtggttctacctgaacaaggactgcaccaacgtgggccccatctccatcgtgcagctgaccgccttcctgaaagagtgcaagcacagccccgagaagggcatcgacccccaggaactgtgggtgtggaagaaaggcatgcccaactgggagaaagtgaagaacatccccgagctgagcggcaccgtgaaggacgagcaccaccaccatcaccac

SEQ ID NO: 237 - DNA, 390 bp, Artificial Sequence
  Synthetic Polynucleotide
atggaaacccctgcccagctgctgttcctgctgctgctgtggctgcctgataccaccggccctagcagcacccaggacaacagatccatggaccagcaggacagcgaggaatttctgctgcagaacaccctggaagatagcgagatcatcagcatccccgacaccatgaaccagatcgccatcgacaccgagaagtggttctacctgaacaaggactgcaccaacgtgggccccatctccatcgtgcagctgaccgccttcctgaaagagtgcaagcacagccccgagaagggcatcgacccccaggaactgtgggtgtggaagaaaggcatgcccaactgggagaaagtgaagaacatccccgagctgagcggcaccgtgaaggacgaa

SEQ ID NO: 238 - DNA, 516 bp, Artificial Sequence
  Synthetic Polynucleotide
atgaacagcgggatgttccccttcaccttctttctgctgtacatctgcctgggcatgctgaccgcctacctggccaacaagaagaaccggaacctgatcggctggttcctggccggcatgttcttcggaatcttcgccatcatttttctgctgatcctgccccccctgcccagcagcacacaggacaacagatccatggaccagcaggacagcgaagagttcctgctgcagaacaccctggaagatagcgagatcatcagcatccccgacaccatgaaccagatcgccatcgacaccgagaagtggttctacctgaacaaggactgcaccaacgtgggccccatctccatcgtgcagctgacagccttcctgaaagagtgcaagcacagccccgagaagggcatcgacccccaggaactgtgggtgtggaagaaaggcatgcccaactgggagaaagtgaagaacatccccgagctgagcggcaccgtgaaggacgagcaccaccaccatcaccac

SEQ ID NO: 239 - DNA, 498 bp, Artificial Sequence
  Synthetic Polynucleotide
atgaacagcgggatgttccccttcaccttctttctgctgtacatctgcctgggcatgctgaccgcctacctggccaacaagaagaaccggaacctgatcggctggttcctggccggcatgttcttcggaatcttcgccatcatttttctgctgatcctgccccccctgcccagcagcacacaggacaacagatccatggaccagcaggacagcgaagagttcctgctgcagaacaccctggaagatagcgagatcatcagcatccccgacaccatgaaccagatcgccatcgacaccgagaagtggttctacctgaacaaggactgcaccaacgtgggccccatctccatcgtgcagctgacagccttcctgaaagagtgcaagcacagccccgagaagggcatcgacccccaggaactgtgggtgtggaagaaaggcatgcccaactgggagaaagtgaagaacatccccgagctgagcggcaccgtgaaggacgaa

SEQ ID NO: 240 - DNA, 1653 bp, Artificial Sequence
  Synthetic Polynucleotide
atggaaacccctgcccagctgctgttcctgctcctgctgtggctgcctgataccacaggcagcggcgtgctggaaaccagcatggccgagagcctgagcaccaacgtgatcagcctggccgacaccaaggccaaggacaacaccagccacaagagcaagaaggcccggaagaaccacagcaaagaaaccctggtggaccggaaagaggtggcccctgtgcacgagtctaaggccacaggccccaagcaggacagctgcttcggccggatgtacaccgtgaaagtgaacgacgaccggaacgtggaaatcacccaggccgtgcctgagtacgccacagtgggcagcccttaccccatcgagatcaccgccaccggcaagagggattgcgtggatgtgatcattacccaacagctgccttgcgaggccgagttcgtgcgctctgatcctgccaccacccctaccgccgatggcaagctcgtgtggaagatcgacagactgggccagggcgagaagtccaaaatcactgtgtgggtcaagcccctgaaagaggggtgctgctttaccgcagccaccgtgtgtgcctgccccgagattagaagcgtgaccaagtgtggccagcccgccatctgcgtgaagcaggaaggacctgagaacgcctgcctgagatgccccgtggtgtacaagatcaacgtcgtgaaccagggcaccgccattgccagaaacgtggtggtggaaaaccccgtgcccgacggctacgcccacagctctggacagagagtgctgaccttcaccctgggcgacatgcagcccggcgagcacagaaccatcaccgtggaattctgccccctgaagcggggcagagccaccaacattgcgacagtgtcctactgtggcgggcacaagaacaccgcctccgtgaccaccgtgatcaacgagccttgcgtgcaggtgtccattgccggcgctgactggtcctacgtgtgcaagccagtggagtacgtgatctccgtgtccaaccccggcgacctggtgctgagagatgtggtggttgaggataccctgagccctggcgtgacagtcctggaagctgctggcgcccagatcagctgcaacaaggtggtgtggacagtgaaagagctgaaccccggggagtccctgcagtacaaggtgctcgtgcgggcccagacccctggccagttcaccaacaatgtggtcgtgaagtcctgcagcgactgcggcacctgtacctcttgtgccgaggccaccacgtactggaaaggcgtggccgctacccatatgtgcgtggtggatacctgcgaccccgtctgcgtgggcgaaaacaccgtgtaccggatctgtgtgaccaaccggggcagcgccgaggacaccaatgtgtccctgatgctgaagttctccaaagaactgcaacccgtgagcttcagcggccccaccaagggaacaatcactggcaacaccgtcgttttcgacagcctgcctcggctgggctctaaggaaactgtggagttcagcgtgacactgaaggccgtgtctgccggggatgctagaggcgaggccatcctgagcagcgacacactgacggtccctgtgtccgacaccgagaatacccacatctaccaccaccatcatcaccat

SEQ ID NO: 241 - DNA, 1635 bp, Artificial Sequence
  Synthetic Polynucleotide
atggaaacccctgcccagctgctgttcctgctcctgctgtggctgcctgataccacaggcagcggcgtgctggaaaccagcatggccgagagcctgagcaccaacgtgatcagcctggccgacaccaaggccaaggacaacaccagccacaagagcaagaaggcccggaagaaccacagcaaagaaaccctggtggaccggaaagaggtggcccctgtgcacgagtctaaggccacaggccccaagcaggacagctgcttcggccggatgtacaccgtgaaagtgaacgacgaccggaacgtggaaatcacccaggccgtgcctgagtacgccacagtgggcagcccttaccccatcgagatcaccgccaccggcaagagggattgcgtggatgtgatcattacccaacagctgccttgcgaggccgagttcgtgcgctctgatcctgccaccacccctaccgccgatggcaagctcgtgtggaagatcgacagactgggccagggcgagaagtccaaaatcactgtgtgggtcaagcccctgaaagaggggtgctgctttaccgcagccaccgtgtgtgcctgccccgagattagaagcgtgaccaagtgtggccagcccgccatctgcgtgaagcaggaaggacctgagaacgcctgcctgagatgccccgtggtgtacaagatcaacgtcgtgaaccagggcaccgccattgccagaaacgtggtggtggaaaaccccgtgcccgacggctacgcccacagctctggacagagagtgctgaccttcaccctgggcgacatgcagcccggcgagcacagaaccatcaccgtggaattctgccccctgaagcggggcagagccaccaacattgcgacagtgtcctactgtggcgggcacaagaacaccgcctccgtgaccaccgtgatcaacgagccttgcgtgcaggtgtccattgccggcgctgactggtcctacgtgtgcaagccagtggagtacgtgatctccgtgtccaaccccggcgacctggtgctgagagatgtggtggttgaggataccctgagccctggcgtgacagtcctggaagctgctggcgcccagatcagctgcaacaaggtggtgtggacagtgaaagagctgaaccccggggagtccctgcagtacaaggtgctcgtgcgggcccagacccctggccagttcaccaacaatgtggtcgtgaagtcctgcagcgactgcggcacctgtacctcttgtgccgaggccaccacgtactggaaaggcgtggccgctacccatatgtgcgtggtggatacctgcgaccccgtctgcgtgggcgaaaacaccgtgtaccggatctgtgtgaccaaccggggcagcgccgaggacaccaatgtgtccctgatgctgaagttctccaaagaactgcaacccgtgagcttcagcggccccaccaagggaacaatcactggcaacaccgtcgttttcgacagcctgcctcggctgggctctaaggaaactgtggagttcagcgtgacactgaaggccgtgtctgccggggatgctagaggcgaggccatcctgagcagcgacacactgacggtccctgtgtccgacaccgagaatacccacatctac

SEQ ID NO: 242 - DNA, 1833 bp, Artificial Sequence
  Synthetic Polynucleotide
atggaaactcccgcacagttacttttcttgttgcttctatggctccccgataccaccgggatgagcatcagaggcgtcggcgggaacggcaacagcagaattccctcccacaacggcgacggcagcaacagaagatcccagaacacaaagggcaataataaggtcgaggacagagtgtgcagcctctactccagcaggtctaacgagaatagggagtccccgtacgccgttgtcgacgtgagttctatgatagagagcacgcccacgtccggagaaacaactagagcaagcaggggcgtcctgagccggttccagagaggtctggtgcgaattgccgacaaggtgagacgggcagtgcaatgcgcctggagcagcgtctccaccagcagaagcagcgccacccgcgctgccgaatcaggcagcagctccagaacggcacggggcgcctcctccggctaccgagagtactcccctagcgccgccagaggcctgagactgatgttcaccgatttttggaggacacgggttctgagacagacctcccccatggctggggtgttcggcaacctggacgtcaatgaagccagactcatggccgcatatacttctgagtgcgctgaccacctggaagctaaggaactggcgggccccgatggcgtggccgcggcccgggagatcgccaagagatgggagaagagagtgcgggacctgcaagacaagggggccgcccggaagctgctgaacgatcccttgggccgccggacaccgaactatcagagcaagaacccgggcgagtacaccgtgggaaacagcatgttctatgacggacctcaggtggcaaacctgcagaacgtggacactggattttggctcgacatgagtaacctctccgatgtcgttctgtctcgtgagatacagacaggtctgcgggctagagccacccttgaggagagcatgcctatgttggagaatctggaggagcggttcagaagactgcaggagacttgcgatgccgccaggaccgagattgaggagagcggctggacccgggaaagcgcctcaaggatggagggagacgaggcccagggaccctccagggttcagcaggccttccagtcgttcgtgaatgaatgcaacagcatcgagttcagcttcggaagcttcggagagcacgtgcgagtgctgtgcgccagagtatccagaggtctggccgctgcaggcgaggccatccggagatgcttctcctgctgcaaaggcagcacccacaggtatgctcccagggatgatctttctcccgagggagccagcctggctgagactcttgcaagattcgccgatgacatggggatcgagcggggcgctgacggcacctacgacattcccctggtggacgactggaggaggggagtgccctccatcgagggcgagggctccgattcaatctatgagatcatgatgcctatttacgaggtgatgaacatggacctggagacaagaagaagtttcgccgtccagcagggtcattaccaggacccccgagcaagcgactacgatctgcctcgcgccagcgattacgacctgcctagaagcccctaccctacacctccactgcccccaagatatcagctccagaacatggacgtggaggccggcttcagggaggccgtgtacgccagctttgtggccggcatgtacaactatgtcgtgacacagcctcaggaacgcattcccaatagccaacaggtggagggcatcctgagagacatgctgaccaacggctctcagacttttagagatctgatgaaaagatggaacagagaagtggacagggag

SEQ ID NO: 243 - DNA, 1833 bp, Artificial Sequence
  Synthetic Polynucleotide
atggaaacaccagctcagctccttttcttactcctcttgtggttgccggataccacaggcatgagcatccggggcgtcggcggcaacggaaacagccggatccccagccacaacggagacggctctaatagaagatcacagaataccaagggaaataacaaggtcgaagatagagtctgcagcttatattccagcagatccaacgagaatagggaaagcccctacgccgtcgttgacgtgagctccatgatcgaaagcaccccaacaagtggcgagactacaagagcctcaaggggcgtcctgtcaagattccaaagaggcctggtgaggatcgcagacaaggtgcggcgggccgtgcagtgcgcctggagctctgtgtcgacaagcagatcaagtgccaccagggccgccgagagcggatcctccagtcggaccgcccgcggcgcctctagtgggtacagagaatatagtcccagcgccgctagggggctgcgcctcatgttcaccgacttctggagaacccgcgtgctcaggcagacatcccctatggccggggtgttcggcaacctggacgtgaacgaggcccggcttatggccgcatatacaagcgagtgtgccgaccacctggaggccaaggagctggctggccccgacggcgtggccgccgcacgcgagattgccaagaggtgggaaaagagggtgagagatctgcaggataagggcgccgccagaaaactgctgaatgaccccctggggaggaggacacccaattaccagtcaaagaatccaggggagtacactgttggaaattctatgttttatgacggccctcaggtggccaaccttcagaatgtggacacaggcttctggcttgacatgagcaacctcagcgacgtggtgctgtctagggagatccagacaggcttaagagcacgggctaccctggaagagtcgatgcccatgctcgaaaatctggaggagaggttcagacgcctgcaagagacatgcgacgccgcgaggactgaaatcgaggagagcggctggaccagggagtccgcttctcgcatggaaggggacgaggctcagggccccagcagggtgcagcaggccttccagagctttgtgaacgagtgcaactccattgagttcagctttggaagcttcggagagcacgtgcgggtgctgtgcgcccgcgtgtccaggggcctggccgcagctggcgaggctatacgtcgctgcttcagctgttgtaagggaagcacccataggtacgcccctcgtgacgatctgtctcccgaaggggccagcctggctgagacactggcccgcttcgccgatgatatggggattgaacggggcgccgacggaacctacgacatccctcttgtggacgactggaggagaggcgtcccctctatcgagggcgagggctctgactccatctacgagattatgatgcctatctacgaggtcatgaacatggacctggaaaccagaagaagcttcgcagttcagcagggacactaccaagacccacgggctagtgattatgacctcccaagagcatccgactatgatctgccaaggtcaccttaccctaccccacccctgcccccacggtaccagttacagaacatggatgtggaggccggcttcagggaagccgtctatgcatccttcgtggccggcatgtacaactacgtggtgactcaacctcaggaacggatccccaacagtcagcaggtggaggggatccttagggatatgctgactaatggaagccagaccttcagagatctgatgaagcggtggaatagggaggtggacagggag

SEQ ID NO: 244 - DNA, 1833 bp, Artificial Sequence
  Synthetic Polynucleotide
atggagacacccgcacagctcctcttcttattgctcttgtggctaccggacaccacaggcatgtctatccggggcgttggcgggaacggcaactctaggatcccctctcacaacggcgacgggagcaacaggagaagccagaacaccaaaggcaataacaaagtcgaggacagagtttgttctctctatagctctaggagcaacgaaaaccgcgaatctccttacgccgtcgtcgacgtcagcagcatgatagagtcaacccctacctctggagaaacaacacgcgcctccagaggcgttctgtccaggttccagaggggcctggtgagaattgccgacaaggtcagacgagccgtgcagtgtgcctggtccagcgtctctaccagcagaagctccgccaccagagccgctgagagtggcagctccagcaggacagccaggggggcttccagcggctatagagagtatagcccttcagccgccagaggcctgcggctgatgttcacagacttttggagaacaagggtgctgcggcagaccagccccatggccggcgtgtttggcaatctggacgtgaacgaggcccggctgatggccgcatacaccagcgagtgtgcggaccacctggaggcaaaggagctggctggacccgacggtgtggccgctgcccgagaaattgccaagaggtgggagaagagagttcgcgacctgcaggataagggcgccgcacggaaactcctgaacgacccactcggcagaagaacccccaactaccagtcaaagaaccctggggagtataccgtgggaaattcaatgttctacgatggccctcaggttgctaatctccagaacgtggacactgggttctggctggacatgagcaacctgagtgacgtggtgctgtctcgggaaattcagacaggcctgcgggccagagccaccctggaagagtccatgcctatgcttgagaacctggaggagcgctttaggcgactccaagaaacctgcgatgctgccaggaccgagatcgaggagtctggatggaccagagaaagcgcctccaggatggagggcgatgaggcccagggccccagcagggtgcagcaggctttccagagcttcgtgaacgaatgtaacagtatcgaattctctttcggtagcttcggcgagcacgtgcgggtgttatgcgccagggtcagcaggggcctggcggccgccggcgaggccatcagaagatgcttcagctgttgcaaaggctcaacccacagatatgcccctagggacgatctgtctccagagggcgctagcttggccgagacactagcaaggttcgccgacgatatgggtatcgagaggggcgccgacggtacctacgacatccccctggtggacgactggaggagaggcgtgcccagtattgagggcgagggatccgacagcatctacgagatcatgatgccgatctacgaggtgatgaatatggatctggagactcgtagatcattcgctgtccagcagggccactaccaggatcctagagcctcggactacgacttgcccagggctagcgattacgacctgcctagatccccctaccccactccccctcttccccctcggtatcagctgcagaacatggacgtggaggccggtttccgagaggctgtgtacgcctccttcgtggccgggatgtacaactacgtcgtgacccagccccaggagagaatccctaattcccagcaggtggagggcatcttgagagatatgctcacaaacgggagccagacctttcgtgacttaatgaagcgatggaacagagaggtggatagggag

SEQ ID NO: 245 - DNA, 1833 bp, Artificial Sequence
  Synthetic Polynucleotide
atggaaacccccgcccagcttctcttcctcctcttgctttggctcccagacacaaccggcatgagtatcagaggcgtaggaggcaacggcaatagccgtatcccctcacacaacggcgacggctccaacagacggagccagaacaccaaggggaataataaggtggaggaccgggtctgttcactttacagctccaggtctaacgagaatcgggaaagcccttacgccgtagtcgacgttagcagtatgatcgaaagcacccccaccagcggcgagacaacaagggcctctcgaggagttctgagcagatttcagagaggcctggtgcggatcgccgacaaggtgcggagagccgtgcagtgcgcctggagcagcgtgagtacatctcggagcagcgccaccagagcagccgaaagcggctcatctagcaggaccgctagaggcgccagctcggggtacagggaatattcaccctccgccgcaagggggctgagactgatgtttacagacttctggagaaccagggtgctgcgccagacaagcccaatggcaggggtgtttggtaacctggatgtgaatgaggccagactgatggccgcctacacttctgagtgcgcggatcatcttgaggccaaggaactggcaggccccgacggcgtggccgccgcccgggagattgctaagagatgggagaagcgggtcagagatctgcaggataagggggccgctaggaaactcctgaatgaccccctaggcaggagaacccctaactaccagagcaaaaatcctggggaatacaccgtgggcaattccatgttttacgatggcccccaagtcgcaaacctccagaatgtggacaccggcttctggctggacatgtccaacttgagcgacgtggttctaagcagagaaatccagaccggactccgcgcgagagctacactcgaggaaagcatgcctatgctggagaatctggaggagcgattccgtcgtctacaggagacttgtgacgccgctaggaccgagatcgaggagagcggctggacaagagaaagcgcctctcgaatggagggcgatgaggcccagggcccctcccgggtgcagcaggcctttcagagcttcgtgaatgagtgcaattctattgagttcagcttcggctcttttggcgagcacgtgcgggtgctttgcgccagggtgtcccggggactggcagccgccggcgaggccataagaagatgtttctcctgctgcaagggcagcacccaccggtatgctcccagagacgacctgtctccagaaggggcatcgctggccgagacactggcacggttcgccgacgatatgggcattgagaggggagccgacggcacttatgatatccctctcgtggacgactggagaagaggagtcccctcaattgagggcgaaggatccgattctatctatgagatcatgatgcctatctacgaagtgatgaatatggacctggaaaccaggagatctttcgctgtgcagcagggccattaccaggatccccgcgccagcgattatgacctgcccagagcctcagactacgatttgcccagaagcccctaccccacccctccgctgccccctagataccagctgcagaatatggacgtggaggctggctttagggaggctgtgtacgctagcttcgtggccggcatgtacaactacgtggtgacacagccccaggagagaattcccaattctcaacaagtagagggcatcctgagagacatgttaacaaacggatctcagaccttccgcgacctgatgaagcggtggaaccgggaagtggaccgcgag

SEQ ID NO: 246 - DNA, 1851 bp, Artificial Sequence
  Synthetic Polynucleotide
atggaaacacccgcccagctcctctttctacttctcctttggcttcccgacaccaccggtatgagcattagaggagtcggcgggaacgggaatagccgtatcccctcccacaacggcgacggcagcaaccgcagaagccagaatactaagggaaacaataaggttgaggaccgcgtctgtagcttgtacagctcaagaagtaacgagaacagagagagcccctacgccgtggtcgacgtttccagcatgatcgagtcaacgcccacaagcggcgaaaccacccgcgcgtcaaggggggtcctgtcccggttccagagaggcctggtgaggatcgccgacaaggtgagacgggccgtgcagtgcgcctggtccagcgtcagcacatcacggtcctccgctaccagggccgccgagtcaggcagcagctctcgtaccgcccggggagcctcaagcgggtacagagagtacagcccttctgccgctagaggcctgagactcatgtttacagacttctggcggacaagggttctcaggcagactagccctatggctggcgtgtttggcaatcttgatgttaacgaagccaggctgatggctgcatatacaagcgaatgcgccgaccatctggaagctaaggagctggccgggcccgacggcgtggccgctgccagggagatcgccaagaggtgggagaaaagggtgcgagatctccaggataagggagcagctagaaagctgctgaacgaccccctgggcaggcggacccctaactaccagagcaaaaatccgggcgagtacaccgtcggcaacagcatgttttacgatggccctcaggtggccaaccttcagaacgtggacaccggcttctggctcgatatgtctaatctttccgacgtcgtgctcagccgggaaatccagactggtctgcgcgccagagctaccttggaagagagcatgcccatgctggagaacctggaggagagatttcggcgcttacaggaaacatgtgacgctgctaggaccgagattgaagagagcgggtggacaagggagtcggcgagcaggatggagggggacgaggcccagggccccagcagggtgcaacaggcttttcagtccttcgtgaacgagtgcaacagcatcgagttctccttcggcagcttcggggagcacgtgagagtgttgtgcgcccgcgtgtctaggggattagccgccgcaggcgaagccatccggcgctgcttcagctgctgcaagggctccacccatcgctacgcccctagagacgacctgtctcccgaaggcgcctccctggccgagactctggcccgattcgccgatgacatgggcatcgagcggggggccgatggcacctacgacatccctctggtcgatgactggcggaggggcgttccctctattgagggcgagggctctgactctatttacgagattatgatgcccatctacgaagtgatgaacatggacttggaaactcgcagatcgtttgcagtgcaacagggtcattaccaggaccctagagcctccgattatgacctgccaagagctagcgattatgacctccctagatcaccctaccccacacctcctctccctccacggtatcagctgcagaacatggacgttgaggcagggtttagggaggccgtgtacgccagcttcgtggcaggcatgtataattatgtggtaacccagccacaggagcgaattcccaactctcaacaggtggagggcatcctgagagacatgctcaccaacggcagccaaaccttcagggaccttatgaaacggtggaatagagaagttgatcgcgagcaccaccaccaccaccac

SEQ ID NO: 247 - DNA, 1851 bp, Artificial Sequence
  Synthetic Polynucleotide
atggaaactcccgcacagttacttttcttgttgcttctatggctccccgataccaccgggatgagcatcagaggcgtcggcgggaacggcaacagcagaattccctcccacaacggcgacggcagcaacagaagatcccagaacacaaagggcaataataaggtcgaggacagagtgtgcagcctctactccagcaggtctaacgagaatagggagtccccgtacgccgttgtcgacgtgagttctatgatagagagcacgcccacgtccggagaaacaactagagcaagcaggggcgtcctgagccggttccagagaggtctggtgcgaattgccgacaaggtgagacgggcagtgcaatgcgcctggagcagcgtctccaccagcagaagcagcgccacccgcgctgccgaatcaggcagcagctccagaacggcacggggcgcctcctccggctaccgagagtactcccctagcgccgccagaggcctgagactgatgttcaccgatttttggaggacacgggttctgagacagacctcccccatggctggggtgttcggcaacctggacgtcaatgaagccagactcatggccgcatatacttctgagtgcgctgaccacctggaagctaaggaactggcgggccccgatggcgtggccgcggcccgggagatcgccaagagatgggagaagagagtgcgggacctgcaagacaagggggccgcccggaagctgctgaacgatcccttgggccgccggacaccgaactatcagagcaagaacccgggcgagtacaccgtgggaaacagcatgttctatgacggacctcaggtggcaaacctgcagaacgtggacactggattttggctcgacatgagtaacctctccgatgtcgttctgtctcgtgagatacagacaggtctgcgggctagagccacccttgaggagagcatgcctatgttggagaatctggaggagcggttcagaagactgcaggagacttgcgatgccgccaggaccgagattgaggagagcggctggacccgggaaagcgcctcaaggatggagggagacgaggcccagggaccctccagggttcagcaggccttccagtcgttcgtgaatgaatgcaacagcatcgagttcagcttcggaagcttcggagagcacgtgcgagtgctgtgcgccagagtatccagaggtctggccgctgcaggcgaggccatccggagatgcttctcctgctgcaaaggcagcacccacaggtatgctcccagggatgatctttctcccgagggagccagcctggctgagactcttgcaagattcgccgatgacatggggatcgagcggggcgctgacggcacctacgacattcccctggtggacgactggaggaggggagtgccctccatcgagggcgagggctccgattcaatctatgagatcatgatgcctatttacgaggtgatgaacatggacctggagacaagaagaagtttcgccgtccagcagggtcattaccaggacccccgagcaagcgactacgatctgcctcgcgccagcgattacgacctgcctagaagcccctaccctacacctccactgcccccaagatatcagctccagaacatggacgtggaggccggcttcagggaggccgtgtacgccagctttgtggccggcatgtacaactatgtcgtgacacagcctcaggaacgcattcccaatagccaacaggtggagggcatcctgagagacatgctgaccaacggctctcagacttttagagatctgatgaaaagatggaacagagaagtggacagggagcaccaccaccaccaccac

SEQ ID NO: 248 - DNA, 1851 bp, Artificial Sequence
  Synthetic Polynucleotide
atggaaacaccagctcagctccttttcttactcctcttgtggttgccggataccacaggcatgagcatccggggcgtcggcggcaacggaaacagccggatccccagccacaacggagacggctctaatagaagatcacagaataccaagggaaataacaaggtcgaagatagagtctgcagcttatattccagcagatccaacgagaatagggaaagcccctacgccgtcgttgacgtgagctccatgatcgaaagcaccccaacaagtggcgagactacaagagcctcaaggggcgtcctgtcaagattccaaagaggcctggtgaggatcgcagacaaggtgcggcgggccgtgcagtgcgcctggagctctgtgtcgacaagcagatcaagtgccaccagggccgccgagagcggatcctccagtcggaccgcccgcggcgcctctagtgggtacagagaatatagtcccagcgccgctagggggctgcgcctcatgttcaccgacttctggagaacccgcgtgctcaggcagacatcccctatggccggggtgttcggcaacctggacgtgaacgaggcccggcttatggccgcatatacaagcgagtgtgccgaccacctggaggccaaggagctggctggccccgacggcgtggccgccgcacgcgagattgccaagaggtgggaaaagagggtgagagatctgcaggataagggcgccgccagaaaactgctgaatgaccccctggggaggaggacacccaattaccagtcaaagaatccaggggagtacactgttggaaattctatgttttatgacggccctcaggtggccaaccttcagaatgtggacacaggcttctggcttgacatgagcaacctcagcgacgtggtgctgtctagggagatccagacaggcttaagagcacgggctaccctggaagagtcgatgcccatgctcgaaaatctggaggagaggttcagacgcctgcaagagacatgcgacgccgcgaggactgaaatcgaggagagcggctggaccagggagtccgcttctcgcatggaaggggacgaggctcagggccccagcagggtgcagcaggccttccagagctttgtgaacgagtgcaactccattgagttcagctttggaagcttcggagagcacgtgcgggtgctgtgcgcccgcgtgtccaggggcctggccgcagctggcgaggctatacgtcgctgcttcagctgttgtaagggaagcacccataggtacgcccctcgtgacgatctgtctcccgaaggggccagcctggctgagacactggcccgcttcgccgatgatatggggattgaacggggcgccgacggaacctacgacatccctcttgtggacgactggaggagaggcgtcccctctatcgagggcgagggctctgactccatctacgagattatgatgcctatctacgaggtcatgaacatggacctggaaaccagaagaagcttcgcagttcagcagggacactaccaagacccacgggctagtgattatgacctcccaagagcatccgactatgatctgccaaggtcaccttaccctaccccacccctgcccccacggtaccagttacagaacatggatgtggaggccggcttcagggaagccgtctatgcatccttcgtggccggcatgtacaactacgtggtgactcaacctcaggaacggatccccaacagtcagcaggtggaggggatccttagggatatgctgactaatggaagccagaccttcagagatctgatgaagcggtggaatagggaggtggacagggagcaccatcaccatcaccac

SEQ ID NO: 249 - DNA, 1851 bp, Artificial Sequence
  Synthetic Polynucleotide
atggagacacccgcacagctcctcttcttattgctcttgtggctaccggacaccacaggcatgtctatccggggcgttggcgggaacggcaactctaggatcccctctcacaacggcgacgggagcaacaggagaagccagaacaccaaaggcaataacaaagtcgaggacagagtttgttctctctatagctctaggagcaacgaaaaccgcgaatctccttacgccgtcgtcgacgtcagcagcatgatagagtcaacccctacctctggagaaacaacacgcgcctccagaggcgttctgtccaggttccagaggggcctggtgagaattgccgacaaggtcagacgagccgtgcagtgtgcctggtccagcgtctctaccagcagaagctccgccaccagagccgctgagagtggcagctccagcaggacagccaggggggcttccagcggctatagagagtatagcccttcagccgccagaggcctgcggctgatgttcacagacttttggagaacaagggtgctgcggcagaccagccccatggccggcgtgtttggcaatctggacgtgaacgaggcccggctgatggccgcatacaccagcgagtgtgcggaccacctggaggcaaaggagctggctggacccgacggtgtggccgctgcccgagaaattgccaagaggtgggagaagagagttcgcgacctgcaggataagggcgccgcacggaaactcctgaacgacccactcggcagaagaacccccaactaccagtcaaagaaccctggggagtataccgtgggaaattcaatgttctacgatggccctcaggttgctaatctccagaacgtggacactgggttctggctggacatgagcaacctgagtgacgtggtgctgtctcgggaaattcagacaggcctgcgggccagagccaccctggaagagtccatgcctatgcttgagaacctggaggagcgctttaggcgactccaagaaacctgcgatgctgccaggaccgagatcgaggagtctggatggaccagagaaagcgcctccaggatggagggcgatgaggcccagggccccagcagggtgcagcaggctttccagagcttcgtgaacgaatgtaacagtatcgaattctctttcggtagcttcggcgagcacgtgcgggtgttatgcgccagggtcagcaggggcctggcggccgccggcgaggccatcagaagatgcttcagctgttgcaaaggctcaacccacagatatgcccctagggacgatctgtctccagagggcgctagcttggccgagacactagcaaggttcgccgacgatatgggtatcgagaggggcgccgacggtacctacgacatccccctggtggacgactggaggagaggcgtgcccagtattgagggcgagggatccgacagcatctacgagatcatgatgccgatctacgaggtgatgaatatggatctggagactcgtagatcattcgctgtccagcagggccactaccaggatcctagagcctcggactacgacttgcccagggctagcgattacgacctgcctagatccccctaccccactccccctcttccccctcggtatcagctgcagaacatggacgtggaggccggtttccgagaggctgtgtacgcctccttcgtggccgggatgtacaactacgtcgtgacccagccccaggagagaatccctaattcccagcaggtggagggcatcttgagagatatgctcacaaacgggagccagacctttcgtgacttaatgaagcgatggaacagagaggtggatagggagcaccaccatcaccaccac

SEQ ID NO: 250 - DNA, 1851 bp, Artificial Sequence
  Synthetic Polynucleotide
atggaaacccccgcccagcttctcttcctcctcttgctttggctcccagacacaaccggcatgagtatcagaggcgtaggaggcaacggcaatagccgtatcccctcacacaacggcgacggctccaacagacggagccagaacaccaaggggaataataaggtggaggaccgggtctgttcactttacagctccaggtctaacgagaatcgggaaagcccttacgccgtagtcgacgttagcagtatgatcgaaagcacccccaccagcggcgagacaacaagggcctctcgaggagttctgagcagatttcagagaggcctggtgcggatcgccgacaaggtgcggagagccgtgcagtgcgcctggagcagcgtgagtacatctcggagcagcgccaccagagcagccgaaagcggctcatctagcaggaccgctagaggcgccagctcggggtacagggaatattcaccctccgccgcaagggggctgagactgatgtttacagacttctggagaaccagggtgctgcgccagacaagcccaatggcaggggtgtttggtaacctggatgtgaatgaggccagactgatggccgcctacacttctgagtgcgcggatcatcttgaggccaaggaactggcaggccccgacggcgtggccgccgcccgggagattgctaagagatgggagaagcgggtcagagatctgcaggataagggggccgctaggaaactcctgaatgaccccctaggcaggagaacccctaactaccagagcaaaaatcctggggaatacaccgtgggcaattccatgttttacgatggcccccaagtcgcaaacctccagaatgtggacaccggcttctggctggacatgtccaacttgagcgacgtggttctaagcagagaaatccagaccggactccgcgcgagagctacactcgaggaaagcatgcctatgctggagaatctggaggagcgattccgtcgtctacaggagacttgtgacgccgctaggaccgagatcgaggagagcggctggacaagagaaagcgcctctcgaatggagggcgatgaggcccagggcccctcccgggtgcagcaggcctttcagagcttcgtgaatgagtgcaattctattgagttcagcttcggctcttttggcgagcacgtgcgggtgctttgcgccagggtgtcccggggactggcagccgccggcgaggccataagaagatgtttctcctgctgcaagggcagcacccaccggtatgctcccagagacgacctgtctccagaaggggcatcgctggccgagacactggcacggttcgccgacgatatgggcattgagaggggagccgacggcacttatgatatccctctcgtggacgactggagaagaggagtcccctcaattgagggcgaaggatccgattctatctatgagatcatgatgcctatctacgaagtgatgaatatggacctggaaaccaggagatctttcgctgtgcagcagggccattaccaggatccccgcgccagcgattatgacctgcccagagcctcagactacgatttgcccagaagcccctaccccacccctccgctgccccctagataccagctgcagaatatggacgtggaggctggctttagggaggctgtgtacgctagcttcgtggccggcatgtacaactacgtggtgacacagccccaggagagaattcccaattctcaacaagtagagggcatcctgagagacatgttaacaaacggatctcagaccttccgcgacctgatgaagcggtggaaccgggaagtggaccgcgagcaccaccaccaccatcat

SEQ ID NO: 251 - DNA, 1899 bp, Artificial Sequence
  Synthetic Polynucleotide
atggaaacccctgcccagctgctgttcctgctgctgctgtggctgcctgacaccaccggcgactataaagaccacgatggcgattacaaagatcacgacatcgattacaaggatgacgacgacaaaatgagcatcagaggcgtgggcggcaacggcaacagcagaatccctagccacaacggcgacggcagcaacaggcggagccagaacaccaagggcaacaacaaggtggaagatagagtgtgcagcctgtacagcagccggtccaacgagaaccgcgagagcccttatgccgtggtggacgtgtccagcatgatcgagagcacccccaccagcggcgagacaaccagagctagtagaggcgtgctgagccggttccagaggggcctcgtgcggattgctgacaaagtgcggagagccgtgcagtgcgcttggagcagcgtgtccacaagcagaagcagcgccacaagagccgccgagagcggcagctctagcagaacagctagaggcgccagcagcggctacagagagtacagcccttctgccgctcggggcctgcggctgatgttcaccgacttttggcggacccgggtgctgagacagacctctcctatggccggcgtgttcggcaacctggacgtgaacgaggccagactgatggccgcctacaccagcgagtgtgccgatcacctggaagccaaagagctggccggacctgacggcgtggcagccgctagagaaatcgccaagagatgggagaagagagtgcgggacctgcaggacaagggcgctgccagaaagctgctgaacgaccccctgggcagacggacccccaactaccagagcaagaaccccggcgagtacaccgtgggcaactccatgttctacgacggcccccaggtggccaacctgcagaatgtggataccggcttctggctggacatgagcaacctgagcgacgtggtgctgtccagagagatccagaccggcctgagagccagagccaccctggaagagtccatgcccatgctggaaaatctggaagagagattccggcggctgcaggaaacctgcgacgccgccagaaccgagatcgaggaaagcggctggacccgggaaagcgcctccagaatggaaggcgacgaagcccagggccccagcagagtgcagcaggcctttcagagcttcgtgaatgagtgcaacagcatcgagttcagcttcggctccttcggcgagcacgtgcgggtgctgtgtgccagagtgtcaagaggactggccgctgccggcgaggccatcagaagatgcttcagctgctgcaagggcagcacccacagatacgcccccagagatgacctgtctcctgagggcgcctctctggccgaaaccctggccagattcgccgacgacatgggcatcgaaagaggcgccgacggcacctacgacatccccctggtggacgattggagaaggggcgtgccatccatcgagggcgagggcagcgatagcatctacgagatcatgatgcccatctacgaagtgatgaacatggacctggaaacccggcggagcttcgccgtgcagcagggccattaccaggaccccagagccagcgactacgacctgcctagagcctccgattacgatctgcccagaagcccctaccccacccctccactgcctcccagataccagctgcagaacatggatgtggaagccggctttcgcgaggccgtgtacgcctcttttgtggccggcatgtacaactacgtcgtgacccagccccaggaacggatccccaatagccagcaggtggaaggcatcctgcgggacatgctgaccaacggcagccagaccttccgggacctgatgaagcggtggaacagagaggtggaccgcgag

SEQ ID NO: 252 - DNA, 1899 bp, Artificial Sequence
  Synthetic Polynucleotide
atggaaacccctgcccagctgctgttcctgctgctgctgtggctgcctgacaccaccggcatgagcatcagaggcgtgggcggcaacggcaacagcagaatccctagccacaacggcgacggcagcaacaggcggagccagaacaccaagggcaacaacaaggtggaagatagagtgtgcagcctgtacagcagccggtccaacgagaaccgcgagagcccttatgccgtggtggacgtgtccagcatgatcgagagcacccccaccagcggcgagacaaccagagctagtagaggcgtgctgagccggttccagaggggcctcgtgcggattgctgacaaagtgcggagagccgtgcagtgcgcttggagcagcgtgtccacaagcagaagcagcgccacaagagccgccgagagcggcagctctagcagaacagctagaggcgccagcagcggctacagagagtacagcccttctgccgctcggggcctgcggctgatgttcaccgacttttggcggacccgggtgctgagacagacctctcctatggccggcgtgttcggcaacctggacgtgaacgaggccagactgatggccgcctacaccagcgagtgtgccgatcacctggaagccaaagagctggccggacctgacggcgtggcagccgctagagaaatcgccaagagatgggagaagagagtgcgggacctgcaggacaagggcgctgccagaaagctgctgaacgaccccctgggcagacggacccccaactaccagagcaagaaccccggcgagtacaccgtgggcaactccatgttctacgacggcccccaggtggccaacctgcagaatgtggataccggcttctggctggacatgagcaacctgagcgacgtggtgctgtccagagagatccagaccggcctgagagccagagccaccctggaagagtccatgcccatgctggaaaatctggaagagagattccggcggctgcaggaaacctgcgacgccgccagaaccgagatcgaggaaagcggctggacccgggaaagcgcctccagaatggaaggcgacgaagcccagggccccagcagagtgcagcaggcctttcagagcttcgtgaatgagtgcaacagcatcgagttcagcttcggctccttcggcgagcacgtgcgggtgctgtgtgccagagtgtcaagaggactggccgctgccggcgaggccatcagaagatgcttcagctgctgcaagggcagcacccacagatacgcccccagagatgacctgtctcctgagggcgcctctctggccgaaaccctggccagattcgccgacgacatgggcatcgaaagaggcgccgacggcacctacgacatccccctggtggacgattggagaaggggcgtgccatccatcgagggcgagggcagcgatagcatctacgagatcatgatgcccatctacgaagtgatgaacatggacctggaaacccggcggagcttcgccgtgcagcagggccattaccaggaccccagagccagcgactacgacctgcctagagcctccgattacgatctgcccagaagcccctaccccacccctccactgcctcccagataccagctgcagaacatggatgtggaagccggctttcgcgaggccgtgtacgcctcttttgtggccggcatgtacaactacgtcgtgacccagccccaggaacggatccccaatagccagcaggtggaaggcatcctgcgggacatgctgaccaacggcagccagaccttccgggacctgatgaagcggtggaacagagaggtggaccgcgaggactataaagaccacgatggcgattacaaagatcacgacatcgattacaaggatgacgacgacaaa

SEQ ID NO: 253 - DNA, 1851 bp, Artificial Sequence
  Synthetic Polynucleotide
atggaaacccctgcccagctgctgttcctgctgctgctgtggctgcctgacaccaccggccaccaccatcaccaccacatgagcatcagaggcgtgggcggcaacggcaacagcagaatccctagccacaacggcgacggcagcaacaggcggagccagaacaccaagggcaacaacaaggtggaagatagagtgtgcagcctgtacagcagccggtccaacgagaaccgcgagagcccttatgccgtggtggacgtgtccagcatgatcgagagcacccccaccagcggcgagacaaccagagctagtagaggcgtgctgagccggttccagaggggcctcgtgcggattgctgacaaagtgcggagagccgtgcagtgcgcttggagcagcgtgtccacaagcagaagcagcgccacaagagccgccgagagcggcagctctagcagaacagctagaggcgccagcagcggctacagagagtacagcccttctgccgctcggggcctgcggctgatgttcaccgacttttggcggacccgggtgctgagacagacctctcctatggccggcgtgttcggcaacctggacgtgaacgaggccagactgatggccgcctacaccagcgagtgtgccgatcacctggaagccaaagagctggccggacctgacggcgtggcagccgctagagaaatcgccaagagatgggagaagagagtgcgggacctgcaggacaagggcgctgccagaaagctgctgaacgaccccctgggcagacggacccccaactaccagagcaagaaccccggcgagtacaccgtgggcaactccatgttctacgacggcccccaggtggccaacctgcagaatgtggataccggcttctggctggacatgagcaacctgagcgacgtggtgctgtccagagagatccagaccggcctgagagccagagccaccctggaagagtccatgcccatgctggaaaatctggaagagagattccggcggctgcaggaaacctgcgacgccgccagaaccgagatcgaggaaagcggctggacccgggaaagcgcctccagaatggaaggcgacgaagcccagggccccagcagagtgcagcaggcctttcagagcttcgtgaatgagtgcaacagcatcgagttcagcttcggctccttcggcgagcacgtgcgggtgctgtgtgccagagtgtcaagaggactggccgctgccggcgaggccatcagaagatgcttcagctgctgcaagggcagcacccacagatacgcccccagagatgacctgtctcctgagggcgcctctctggccgaaaccctggccagattcgccgacgacatgggcatcgaaagaggcgccgacggcacctacgacatccccctggtggacgattggagaaggggcgtgccatccatcgagggcgagggcagcgatagcatctacgagatcatgatgcccatctacgaagtgatgaacatggacctggaaacccggcggagcttcgccgtgcagcagggccattaccaggaccccagagccagcgactacgacctgcctagagcctccgattacgatctgcccagaagcccctaccccacccctccactgcctcccagataccagctgcagaacatggatgtggaagccggctttcgcgaggccgtgtacgcctcttttgtggccggcatgtacaactacgtcgtgacccagccccaggaacggatccccaatagccagcaggtggaaggcatcctgcgggacatgctgaccaacggcagccagaccttccgggacctgatgaagcggtggaacagagaggtggaccgcgag

SEQ ID NO: 254 - DNA, 1179 bp, Artificial Sequence
  Synthetic Polynucleotide
atgggccctggcagatgtctgctgacagccctgctgctgctggccctggctcctccacctgaagctctgcccgtgggaaatcctgccgagcccagcctgatgatcgacggcattctgtgggagggcttcggcggcgacccttgcgatccttgtaccacttggtgcgacgccatcagcatgagaatgggctactacggcgacttcgtgttcgaccgggtgctgaaaaccgacgtgaacaaagaattccagatgggcgacaagcccaccagcaccaccggaaatgccaccgcccctaccaccctgaccgccagagaaaatcccgcctacggccggcacatgcaggacgccgagatgttcaccaacgccgcctgcatggccctgaacatctgggacagattcgacgtgttctgcaccctgggcgccagcagcggctacctgaagggcaatagcgccagcttcaacctcgtgggcctgttcggcgacaacgagaaccagagcaccgtgaaaacaaacagcgtgcccaacatgagcctggaccagagcgtggtggaactgtacaccgacaccgcattctcttggagcgtgggagccagagctgccctgtgggagtgtggatgtgccacactgggcgctagcttccagtacgcccagagcaagcccaaggtggaagaactgaacgtgctgtgcaatgccgccgagttcaccatcaacaagcctaagggctacgtgggccaggaattccccctggccctgatcgccggaacagatgccgccaccggaacaaaggacgccagcatcgactaccacgagtggcaggcttctctggccctgtcctaccggctgaatatgttcaccccctacatcggcgtgaagtggtcccgggccagcttcgatgccgacaccatcagaatcgcccagcccaagagcgccaccgccatcttcgataccaccacactgaaccccaccattgccggcgctggcgacgtgaaagcctctgccgaaggacagctgggcgacacaatgcagatcgtgtccctgcagctgaacaagatgaagtcccggaagtcctgcggaatcgccgtgggcaccacaatcgtggacgccgataagtacgccgtgaccgtggaaacccggctgatcgatgagagggccgctcacgtgaacgcccagttcagattc

SEQ ID NO: 255 - DNA, 1197 bp, Artificial Sequence
  Synthetic Polynucleotide
atgggccctggcagatgtctgctgacagccctgctgctgctggccctggctcctccacctgaagctctgcccgtgggaaatcctgccgagcccagcctgatgatcgacggcattctgtgggagggcttcggcggcgacccttgcgatccttgtaccacttggtgcgacgccatcagcatgagaatgggctactacggcgacttcgtgttcgaccgggtgctgaaaaccgacgtgaacaaagaattccagatgggcgacaagcccaccagcaccaccggaaatgccaccgcccctaccaccctgaccgccagagaaaatcccgcctacggccggcacatgcaggacgccgagatgttcaccaacgccgcctgcatggccctgaacatctgggacagattcgacgtgttctgcaccctgggcgccagcagcggctacctgaagggcaatagcgccagcttcaacctcgtgggcctgttcggcgacaacgagaaccagagcaccgtgaaaacaaacagcgtgcccaacatgagcctggaccagagcgtggtggaactgtacaccgacaccgcattctcttggagcgtgggagccagagctgccctgtgggagtgtggatgtgccacactgggcgctagcttccagtacgcccagagcaagcccaaggtggaagaactgaacgtgctgtgcaatgccgccgagttcaccatcaacaagcctaagggctacgtgggccaggaattccccctggccctgatcgccggaacagatgccgccaccggaacaaaggacgccagcatcgactaccacgagtggcaggcttctctggccctgtcctaccggctgaatatgttcaccccctacatcggcgtgaagtggtcccgggccagcttcgatgccgacaccatcagaatcgcccagcccaagagcgccaccgccatcttcgataccaccacactgaaccccaccattgccggcgctggcgacgtgaaagcctctgccgaaggacagctgggcgacacaatgcagatcgtgtccctgcagctgaacaagatgaagtcccggaagtcctgcggaatcgccgtgggcaccacaatcgtggacgccgataagtacgccgtgaccgtggaaacccggctgatcgatgagagggccgctcacgtgaacgcccagttcagattccaccaccaccatcaccac

SEQ ID NO: 256 - DNA, 1218 bp, Artificial Sequence
  Synthetic Polynucleotide
atgggcctgcagaccaccaagtggcctagccacggcgcattctttctgaagtcctggctgatcatctccctgggcctgtacagccaggtgtccaagctgctggctctgcccgtgggaaatcctgccgagcccagcctgatgatcgacggcattctgtgggagggcttcggcggcgacccttgcgatccttgtaccacttggtgcgacgccatcagcatgagaatgggctactacggcgacttcgtgttcgaccgggtgctgaaaaccgacgtgaacaaagaattccagatgggcgacaagcccaccagcaccaccggaaatgccaccgcccctaccaccctgaccgccagagaaaatcccgcctacggccggcacatgcaggacgccgagatgttcaccaacgccgcctgcatggccctgaacatctgggacagattcgacgtgttctgcaccctgggcgccagcagcggctacctgaagggcaatagcgccagcttcaacctcgtgggcctgttcggcgacaacgagaaccagagcaccgtgaaaacaaacagcgtgcccaacatgagcctggaccagagcgtggtggaactgtacaccgacaccgcattctcttggagcgtgggagccagagctgccctgtgggagtgtggatgtgccacactgggcgctagcttccagtacgcccagagcaagcccaaggtggaagaactgaacgtgctgtgcaatgccgccgagttcaccatcaacaagcctaagggctacgtgggccaggaattccccctggccctgatcgccggaacagatgccgccaccggaacaaaggacgccagcatcgactaccacgagtggcaggcttctctggccctgtcctaccggctgaatatgttcaccccctacatcggcgtgaagtggtcccgggccagcttcgatgccgacaccatcagaatcgcccagcccaagagcgccaccgccatcttcgataccaccacactgaaccccaccattgccggcgctggcgacgtgaaagcctctgccgaaggacagctgggcgacacaatgcagatcgtgtccctgcagctgaacaagatgaagtcccggaagtcctgcggaatcgccgtgggcaccacaatcgtggacgccgataagtacgccgtgaccgtggaaacccggctgatcgatgagagggccgctcacgtgaacgcccagttcagattc

SEQ ID NO: 257 - DNA, 1236 bp, Artificial Sequence
  Synthetic Polynucleotide
atgggcctgcagaccaccaagtggcctagccacggcgcattctttctgaagtcctggctgatcatctccctgggcctgtacagccaggtgtccaagctgctggctctgcccgtgggaaatcctgccgagcccagcctgatgatcgacggcattctgtgggagggcttcggcggcgacccttgcgatccttgtaccacttggtgcgacgccatcagcatgagaatgggctactacggcgacttcgtgttcgaccgggtgctgaaaaccgacgtgaacaaagaattccagatgggcgacaagcccaccagcaccaccggaaatgccaccgcccctaccaccctgaccgccagagaaaatcccgcctacggccggcacatgcaggacgccgagatgttcaccaacgccgcctgcatggccctgaacatctgggacagattcgacgtgttctgcaccctgggcgccagcagcggctacctgaagggcaatagcgccagcttcaacctcgtgggcctgttcggcgacaacgagaaccagagcaccgtgaaaacaaacagcgtgcccaacatgagcctggaccagagcgtggtggaactgtacaccgacaccgcattctcttggagcgtgggagccagagctgccctgtgggagtgtggatgtgccacactgggcgctagcttccagtacgcccagagcaagcccaaggtggaagaactgaacgtgctgtgcaatgccgccgagttcaccatcaacaagcctaagggctacgtgggccaggaattccccctggccctgatcgccggaacagatgccgccaccggaacaaaggacgccagcatcgactaccacgagtggcaggcttctctggccctgtcctaccggctgaatatgttcaccccctacatcggcgtgaagtggtcccgggccagcttcgatgccgacaccatcagaatcgcccagcccaagagcgccaccgccatcttcgataccaccacactgaaccccaccattgccggcgctggcgacgtgaaagcctctgccgaaggacagctgggcgacacaatgcagatcgtgtccctgcagctgaacaagatgaagtcccggaagtcctgcggaatcgccgtgggcaccacaatcgtggacgccgataagtacgccgtgaccgtggaaacccggctgatcgatgagagggccgctcacgtgaacgcccagttcagattccaccaccaccatcaccac

SEQ ID NO: 258 - DNA, 1173 bp, Artificial Sequence
  Synthetic Polynucleotide
atggaaacccctgcccagctgctgttcctgctgctgctgtggctgcctgacaccaccggcctgcccgtgggaaatcctgccgagcccagcctgatgatcgacggcattctgtgggagggcttcggcggcgacccttgcgatccttgtaccacttggtgcgacgccatcagcatgagaatgggctactacggcgacttcgtgttcgaccgggtgctgaaaaccgacgtgaacaaagaattccagatgggcgacaagcccaccagcaccaccggaaatgccaccgcccctaccaccctgaccgccagagaaaatcccgcctacggccggcacatgcaggacgccgagatgttcaccaacgccgcctgcatggccctgaacatctgggacagattcgacgtgttctgcaccctgggcgccagcagcggctacctgaagggcaatagcgccagcttcaacctcgtgggcctgttcggcgacaacgagaaccagagcaccgtgaaaacaaacagcgtgcccaacatgagcctggaccagagcgtggtggaactgtacaccgacaccgcattctcttggagcgtgggagccagagctgccctgtgggagtgtggatgtgccacactgggcgctagcttccagtacgcccagagcaagcccaaggtggaagaactgaacgtgctgtgcaatgccgccgagttcaccatcaacaagcctaagggctacgtgggccaggaattccccctggccctgatcgccggaacagatgccgccaccggaacaaaggacgccagcatcgactaccacgagtggcaggcttctctggccctgtcctaccggctgaatatgttcaccccctacatcggcgtgaagtggtcccgggccagcttcgatgccgacaccatcagaatcgcccagcccaagagcgccaccgccatcttcgataccaccacactgaaccccaccattgccggcgctggcgacgtgaaagcctctgccgaaggacagctgggcgacacaatgcagatcgtgtccctgcagctgaacaagatgaagtcccggaagtcctgcggaatcgccgtgggcaccacaatcgtggacgccgataagtacgccgtgaccgtggaaacccggctgatcgatgagagggccgctcacgtgaacgcccagttcagattc

SEQ ID NO: 259 - DNA, 1191 bp, Artificial Sequence
  Synthetic Polynucleotide
atggaaacccctgcccagctgctgttcctgctgctgctgtggctgcctgacaccaccggcctgcccgtgggaaatcctgccgagcccagcctgatgatcgacggcattctgtgggagggcttcggcggcgacccttgcgatccttgtaccacttggtgcgacgccatcagcatgagaatgggctactacggcgacttcgtgttcgaccgggtgctgaaaaccgacgtgaacaaagaattccagatgggcgacaagcccaccagcaccaccggaaatgccaccgcccctaccaccctgaccgccagagaaaatcccgcctacggccggcacatgcaggacgccgagatgttcaccaacgccgcctgcatggccctgaacatctgggacagattcgacgtgttctgcaccctgggcgccagcagcggctacctgaagggcaatagcgccagcttcaacctcgtgggcctgttcggcgacaacgagaaccagagcaccgtgaaaacaaacagcgtgcccaacatgagcctggaccagagcgtggtggaactgtacaccgacaccgcattctcttggagcgtgggagccagagctgccctgtgggagtgtggatgtgccacactgggcgctagcttccagtacgcccagagcaagcccaaggtggaagaactgaacgtgctgtgcaatgccgccgagttcaccatcaacaagcctaagggctacgtgggccaggaattccccctggccctgatcgccggaacagatgccgccaccggaacaaaggacgccagcatcgactaccacgagtggcaggcttctctggccctgtcctaccggctgaatatgttcaccccctacatcggcgtgaagtggtcccgggccagcttcgatgccgacaccatcagaatcgcccagcccaagagcgccaccgccatcttcgataccaccacactgaaccccaccattgccggcgctggcgacgtgaaagcctctgccgaaggacagctgggcgacacaatgcagatcgtgtccctgcagctgaacaagatgaagtcccggaagtcctgcggaatcgccgtgggcaccacaatcgtggacgccgataagtacgccgtgaccgtggaaacccggctgatcgatgagagggccgctcacgtgaacgcccagttcagattccaccaccaccatcaccac

SEQ ID NO: 260 - DNA, 1176 bp, Artificial Sequence
  Synthetic Polynucleotide
atgtggtggcggctgtggtggcttctccttctcctcctgctgctgtggcccatggtgtgggccctgcccgtgggaaatcctgccgagcccagcctgatgatcgacggcattctgtgggagggcttcggcggcgacccttgcgatccttgtaccacttggtgcgacgccatcagcatgagaatgggctactacggcgacttcgtgttcgaccgggtgctgaaaaccgacgtgaacaaagaattccagatgggcgacaagcccaccagcaccaccggaaatgccaccgcccctaccaccctgaccgccagagaaaatcccgcctacggccggcacatgcaggacgccgagatgttcaccaacgccgcctgcatggccctgaacatctgggacagattcgacgtgttctgcaccctgggcgccagcagcggctacctgaagggcaatagcgccagcttcaacctcgtgggcctgttcggcgacaacgagaaccagagcaccgtgaaaacaaacagcgtgcccaacatgagcctggaccagagcgtggtggaactgtacaccgacaccgcattctcttggagcgtgggagccagagctgccctgtgggagtgtggatgtgccacactgggcgctagcttccagtacgcccagagcaagcccaaggtggaagaactgaacgtgctgtgcaatgccgccgagttcaccatcaacaagcctaagggctacgtgggccaggaattccccctggccctgatcgccggaacagatgccgccaccggaacaaaggacgccagcatcgactaccacgagtggcaggcttctctggccctgtcctaccggctgaatatgttcaccccctacatcggcgtgaagtggtcccgggccagcttcgatgccgacaccatcagaatcgcccagcccaagagcgccaccgccatcttcgataccaccacactgaaccccaccattgccggcgctggcgacgtgaaagcctctgccgaaggacagctgggcgacacaatgcagatcgtgtccctgcagctgaacaagatgaagtcccggaagtcctgcggaatcgccgtgggcaccacaatcgtggacgccgataagtacgccgtgaccgtggaaacccggctgatcgatgagagggccgctcacgtgaacgcccagttcagattc

SEQ ID NO: 261 - DNA, 1194 bp, Artificial Sequence
  Synthetic Polynucleotide
atgtggtggcggctgtggtggcttctccttctcctcctgctgctgtggcccatggtgtgggccctgcccgtgggaaatcctgccgagcccagcctgatgatcgacggcattctgtgggagggcttcggcggcgacccttgcgatccttgtaccacttggtgcgacgccatcagcatgagaatgggctactacggcgacttcgtgttcgaccgggtgctgaaaaccgacgtgaacaaagaattccagatgggcgacaagcccaccagcaccaccggaaatgccaccgcccctaccaccctgaccgccagagaaaatcccgcctacggccggcacatgcaggacgccgagatgttcaccaacgccgcctgcatggccctgaacatctgggacagattcgacgtgttctgcaccctgggcgccagcagcggctacctgaagggcaatagcgccagcttcaacctcgtgggcctgttcggcgacaacgagaaccagagcaccgtgaaaacaaacagcgtgcccaacatgagcctggaccagagcgtggtggaactgtacaccgacaccgcattctcttggagcgtgggagccagagctgccctgtgggagtgtggatgtgccacactgggcgctagcttccagtacgcccagagcaagcccaaggtggaagaactgaacgtgctgtgcaatgccgccgagttcaccatcaacaagcctaagggctacgtgggccaggaattccccctggccctgatcgccggaacagatgccgccaccggaacaaaggacgccagcatcgactaccacgagtggcaggcttctctggccctgtcctaccggctgaatatgttcaccccctacatcggcgtgaagtggtcccgggccagcttcgatgccgacaccatcagaatcgcccagcccaagagcgccaccgccatcttcgataccaccacactgaaccccaccattgccggcgctggcgacgtgaaagcctctgccgaaggacagctgggcgacacaatgcagatcgtgtccctgcagctgaacaagatgaagtcccggaagtcctgcggaatcgccgtgggcaccacaatcgtggacgccgataagtacgccgtgaccgtggaaacccggctgatcgatgagagggccgctcacgtgaacgcccagttcagattccaccaccaccatcaccac

SEQ ID NO: 262 - DNA, 1803 bp, Artificial Sequence
  Synthetic Polynucleotide
atggaaacccctgcccagctgctgttcctgctgctgctgtggctgcctgataccacaggcgtgcggggagagtccctcgtgtgcaagaatgccctgcaggacctgagcttcctggaacatctgctgcaagtgaagtacgcccccaagacctggaaagagcagtacctgggctgggacctggtgcagtcctctgtgtctgcccagcagaagctgcggacccaggaaaacccctctaccagcttctgtcagcaagtgctggccgacttcatcggcggcctgaacgatttcgccgccggcgtgacctttttcgccatcgagagcgcctacctgccctacaccgtgcagaagtccagcgacggccggttctacttcgtggacatcatgaccttcagcagcgagatcagagtgggcgacgagctgctggaagtggatggcgctcctgtgcaggatgtgctggccacactgtacggcagcaaccacaagggcacagccgccgaagaatctgccgccctgagaaccctgttcagccggatggcctctctgggccacaaggtgccaagcggcagaaccaccctgaagatcagacggccctttggcaccacccgggaagtgcgcgtgaagtggcgctatgtgcctgagggcgtgggcgacctggccacaatcgccccttctatcagagccccccagctgcagaaatccatgcggtcattcttcccaaagaaggacgacgccttccaccggtccagcagcctgttctacagccctatggtgccccacttctgggccgagctgagaaaccactacgccacctccggcctgaagtccggctacaacatcggcagcaccgacggctttctgcccgtgatcggacccgtgatctgggagagcgagggcctgttcagagcctacatcagcagcgtgaccgacggcgacggcaagagccacaaagtgggctttctgagaatccccacctacagctggcaggacatggaagatttcgaccccagcggcccacccccctgggaggaatttgccaagatcatccaggtgttcagcagcaacaccgaggccctgatcatcgaccagaccaacaaccctggcggcagcgtgctgtacctgtacgccctgctgagcatgctgaccgacagacccctggaactgcccaagcaccggatgatcctgacccaggacgaggtggtggacgccctggattggctgaccctgctggaaaacgtggacaccaacgtggaaagccggctggccctgggcgacaacatggaaggctacacagtggatctgcaggtggccgagtacctgaaaagcttcggcagacaggtgctgaactgctggtccaagggcgacatcgagctgagcacccccatccccctgttcggcttcgagaagatccacccccaccccagagtgcagtacagcaagcccatctgcgtgctgatcaacgagcaggacttctcctgcgccgacttcttcccagtggtgctgaaggacaacgacagagccctgatcgtgggcaccagaacagctggcgctggcggcttcgtgttcaacgtgcagttccccaaccggaccggcatcaagacctgtagcctgacaggctctctggccgtgcgggaacacggcgccttcatcgagaacatcggcgtggaaccccacatcgacctgcctttcaccgccaacgacatccggtacaagggctactctgagtacctggacaaagtgaagaaactcgtgtgccagctgattaacaacgacggcaccatcatcctggccgaggacggcagcttc

SEQ ID NO: 263 - DNA, 1821 bp, Artificial Sequence
  Synthetic Polynucleotide
atggaaacccctgcccagctgctgttcctgctgctgctgtggctgcctgataccacaggcgtgcggggagagtccctcgtgtgcaagaatgccctgcaggacctgagcttcctggaacatctgctgcaagtgaagtacgcccccaagacctggaaagagcagtacctgggctgggacctggtgcagtcctctgtgtctgcccagcagaagctgcggacccaggaaaacccctctaccagcttctgtcagcaagtgctggccgacttcatcggcggcctgaacgatttcgccgccggcgtgacctttttcgccatcgagagcgcctacctgccctacaccgtgcagaagtccagcgacggccggttctacttcgtggacatcatgaccttcagcagcgagatcagagtgggcgacgagctgctggaagtggatggcgctcctgtgcaggatgtgctggccacactgtacggcagcaaccacaagggcacagccgccgaagaatctgccgccctgagaaccctgttcagccggatggcctctctgggccacaaggtgccaagcggcagaaccaccctgaagatcagacggccctttggcaccacccgggaagtgcgcgtgaagtggcgctatgtgcctgagggcgtgggcgacctggccacaatcgccccttctatcagagccccccagctgcagaaatccatgcggtcattcttcccaaagaaggacgacgccttccaccggtccagcagcctgttctacagccctatggtgccccacttctgggccgagctgagaaaccactacgccacctccggcctgaagtccggctacaacatcggcagcaccgacggctttctgcccgtgatcggacccgtgatctgggagagcgagggcctgttcagagcctacatcagcagcgtgaccgacggcgacggcaagagccacaaagtgggctttctgagaatccccacctacagctggcaggacatggaagatttcgaccccagcggcccacccccctgggaggaatttgccaagatcatccaggtgttcagcagcaacaccgaggccctgatcatcgaccagaccaacaaccctggcggcagcgtgctgtacctgtacgccctgctgagcatgctgaccgacagacccctggaactgcccaagcaccggatgatcctgacccaggacgaggtggtggacgccctggattggctgaccctgctggaaaacgtggacaccaacgtggaaagccggctggccctgggcgacaacatggaaggctacacagtggatctgcaggtggccgagtacctgaaaagcttcggcagacaggtgctgaactgctggtccaagggcgacatcgagctgagcacccccatccccctgttcggcttcgagaagatccacccccaccccagagtgcagtacagcaagcccatctgcgtgctgatcaacgagcaggacttctcctgcgccgacttcttcccagtggtgctgaaggacaacgacagagccctgatcgtgggcaccagaacagctggcgctggcggcttcgtgttcaacgtgcagttccccaaccggaccggcatcaagacctgtagcctgacaggctctctggccgtgcgggaacacggcgccttcatcgagaacatcggcgtggaaccccacatcgacctgcctttcaccgccaacgacatccggtacaagggctactctgagtacctggacaaagtgaagaaactcgtgtgccagctgattaacaacgacggcaccatcatcctggccgaggacggcagcttccaccaccaccatcaccac

SEQ ID NO: 264 - DNA, 1803 bp, Artificial Sequence
  Synthetic Polynucleotide
atggaaacccctgcccagctgctgttcctgctgctgctgtggctgcctgataccacaggcgtgcggggagagtccctcgtgtgcaagaatgccctgcaggacctgagcttcctggaacatctgctgcaagtgaagtacgcccccaagacctggaaagagcagtacctgggctgggacctggtgcagtcctctgtgtctgcccagcagaagctgcggacccaggaaaacccctctaccagcttctgtcagcaagtgctggccgacttcatcggcggcctgaacgatttccatgccggcgtgacctttttcgccatcgagagcgcctacctgccctacaccgtgcagaagtccagcgacggccggttctacttcgtggacatcatgaccttcagcagcgagatcagagtgggcgacgagctgctggaagtggatggcgctcctgtgcaggatgtgctggccacactgtacggcagcaaccacaagggcacagccgccgaagaatctgccgccctgagaaccctgttcagccggatggcctctctgggccacaaggtgccaagcggcagaaccaccctgaagatcagacggccctttggcaccacccgggaagtgcgcgtgaagtggcgctatgtgcctgagggcgtgggcgacctggccacaatcgccccttctatcagagccccccagctgcagaaatccatgcggtcattcttcccaaagaaggacgacgccttccaccggtccagcagcctgttctacagccctatggtgccccacttctgggccgagctgagaaaccactacgccacctccggcctgaagtccggctacaacatcggcagcaccgacggctttctgcccgtgatcggacccgtgatctgggagagcgagggcctgttcagagcctacatcagcagcgtgaccgacggcgacggcaagagccacaaagtgggctttctgagaatccccacctacagctggcaggacatggaagatttcgaccccagcggcccacccccctgggaggaatttgccaagatcatccaggtgttcagcagcaacaccgaggccctgatcatcgaccagaccaacaaccctggcggcagcgtgctgtacctgtacgccctgctgagcatgctgaccgacagacccctggaactgcccaagcaccggatgatcctgacccaggacgaggtggtggacgccctggattggctgaccctgctggaaaacgtggacaccaacgtggaaagccggctggccctgggcgacaacatggaaggctacacagtggatctgcaggtggccgagtacctgaaaagcttcggcagacaggtgctgaactgctggtccaagggcgacatcgagctgagcacccccatccccctgttcggcttcgagaagatccacccccaccccagagtgcagtacagcaagcccatctgcgtgctgatcaacgagcaggacttcgcctgcgccgacttcttcccagtggtgctgaaggacaacgacagagccctgatcgtgggcaccagaacagctggcgctggcggcttcgtgttcaacgtgcagttccccaaccggaccggcatcaagacctgtagcctgacaggctctctggccgtgcgggaacacggcgccttcatcgagaacatcggcgtggaaccccacatcgacctgcctttcaccgccaacgacatccggtacaagggctactctgagtacctggacaaagtgaagaaactcgtgtgccagctgattaacaacgacggcaccatcatcctggccgaggacggcagcttc

SEQ ID NO: 265 - DNA, 1821 bp, Artificial Sequence
  Synthetic Polynucleotide
atggaaacccctgcccagctgctgttcctgctgctgctgtggctgcctgataccacaggcgtgcggggagagtccctcgtgtgcaagaatgccctgcaggacctgagcttcctggaacatctgctgcaagtgaagtacgcccccaagacctggaaagagcagtacctgggctgggacctggtgcagtcctctgtgtctgcccagcagaagctgcggacccaggaaaacccctctaccagcttctgtcagcaagtgctggccgacttcatcggcggcctgaacgatttccatgccggcgtgacctttttcgccatcgagagcgcctacctgccctacaccgtgcagaagtccagcgacggccggttctacttcgtggacatcatgaccttcagcagcgagatcagagtgggcgacgagctgctggaagtggatggcgctcctgtgcaggatgtgctggccacactgtacggcagcaaccacaagggcacagccgccgaagaatctgccgccctgagaaccctgttcagccggatggcctctctgggccacaaggtgccaagcggcagaaccaccctgaagatcagacggccctttggcaccacccgggaagtgcgcgtgaagtggcgctatgtgcctgagggcgtgggcgacctggccacaatcgccccttctatcagagccccccagctgcagaaatccatgcggtcattcttcccaaagaaggacgacgccttccaccggtccagcagcctgttctacagccctatggtgccccacttctgggccgagctgagaaaccactacgccacctccggcctgaagtccggctacaacatcggcagcaccgacggctttctgcccgtgatcggacccgtgatctgggagagcgagggcctgttcagagcctacatcagcagcgtgaccgacggcgacggcaagagccacaaagtgggctttctgagaatccccacctacagctggcaggacatggaagatttcgaccccagcggcccacccccctgggaggaatttgccaagatcatccaggtgttcagcagcaacaccgaggccctgatcatcgaccagaccaacaaccctggcggcagcgtgctgtacctgtacgccctgctgagcatgctgaccgacagacccctggaactgcccaagcaccggatgatcctgacccaggacgaggtggtggacgccctggattggctgaccctgctggaaaacgtggacaccaacgtggaaagccggctggccctgggcgacaacatggaaggctacacagtggatctgcaggtggccgagtacctgaaaagcttcggcagacaggtgctgaactgctggtccaagggcgacatcgagctgagcacccccatccccctgttcggcttcgagaagatccacccccaccccagagtgcagtacagcaagcccatctgcgtgctgatcaacgagcaggacttcgcctgcgccgacttcttcccagtggtgctgaaggacaacgacagagccctgatcgtgggcaccagaacagctggcgctggcggcttcgtgttcaacgtgcagttccccaaccggaccggcatcaagacctgtagcctgacaggctctctggccgtgcgggaacacggcgccttcatcgagaacatcggcgtggaaccccacatcgacctgcctttcaccgccaacgacatccggtacaagggctactctgagtacctggacaaagtgaagaaactcgtgtgccagctgattaacaacgacggcaccatcatcctggccgaggacggcagcttccaccaccaccatcaccac

SEQ ID NO: 266 - DNA, 1323 bp, Artificial Sequence
  Synthetic Polynucleotide
atggaaacccctgcccagctgctgttcctgctgctgctgtggctgcctgacaccaccggcatgacagcatctggcggagctggcggcctgggctctacacagacagtggatgtggccagggcccaggctgctgccgctacacaggatgcccaggaagtgatcggcagccaggaagccagcgaggcctctatgctgaagggctgcgaggacctgatcaaccctgccgccgctacccgcatcaagaagaaagaggaaaagttcgagtccctggaagccagacggaagcccaccgccgacaaggccgagaagaagtccgagagcaccgaggaaaagggcgacacccccctggaagatcggttcaccgaggatctgagcgaggtgtccggcgaggacttccggggcctgaagaacagcttcgacgacgacagcagccccgaggaaatcctggacgccctgaccagcaagttcagcgaccccaccatcaaggacctggccctggactacctgatccagaccgcccccagcgaccggaagctgaagtctgccctgattcaggccaagcaccagctgatgagccagaacccccaggccatcgtgggcggcagaaatgtgctgctggcctccgagacattcgccagcagagccaacaccagccccagctccctgcggagcctgtatctgcaagtgaccagctcccccagcaactgcgacaacctgagacagatgctggctagctacctgccctccgagaaaaccgccgtgatggaattcctcgtgaacggcatggtggccgacctgaaaagcgagggccctagcatccctcccgccaagctgcaggtgtacatgaccgagctgagcaacctgcaggccctgcacagcgtggacagctttttcgaccggaacatcggcaacctggaaaacagcctgaagcacgagggccacgcccccatcccttctctgacaaccggcaatctggccaagaccttcctgcagctggtggaagataagttccccagcagctccaaggcccagaaggccctgaacgagctcgtgggccctgataccggacctcagaccgaggtgctgaacctgttctttcgggccctgaatggctgctccccccggatcttttctggcgctgagaagaagcagcagctggccagcgtgatcaccaacaccctggatgccatcaacgccgacaacgaggactaccccaagcccggcgacttccccagaagcagctttagcagcaccccccctcatgcccctgtgccccagtctgagatccctaccagcccaaccagcacccagcctccaagccct

SEQ ID NO: 267 - DNA, 1341 bp, Artificial Sequence
  Synthetic Polynucleotide
atggaaacccctgcccagctgctgttcctgctgctgctgtggctgcctgacaccaccggcatgacagcatctggcggagctggcggcctgggctctacacagacagtggatgtggccagggcccaggctgctgccgctacacaggatgcccaggaagtgatcggcagccaggaagccagcgaggcctctatgctgaagggctgcgaggacctgatcaaccctgccgccgctacccgcatcaagaagaaagaggaaaagttcgagtccctggaagccagacggaagcccaccgccgacaaggccgagaagaagtccgagagcaccgaggaaaagggcgacacccccctggaagatcggttcaccgaggatctgagcgaggtgtccggcgaggacttccggggcctgaagaacagcttcgacgacgacagcagccccgaggaaatcctggacgccctgaccagcaagttcagcgaccccaccatcaaggacctggccctggactacctgatccagaccgcccccagcgaccggaagctgaagtctgccctgattcaggccaagcaccagctgatgagccagaacccccaggccatcgtgggcggcagaaatgtgctgctggcctccgagacattcgccagcagagccaacaccagccccagctccctgcggagcctgtatctgcaagtgaccagctcccccagcaactgcgacaacctgagacagatgctggctagctacctgccctccgagaaaaccgccgtgatggaattcctcgtgaacggcatggtggccgacctgaaaagcgagggccctagcatccctcccgccaagctgcaggtgtacatgaccgagctgagcaacctgcaggccctgcacagcgtggacagctttttcgaccggaacatcggcaacctggaaaacagcctgaagcacgagggccacgcccccatcccttctctgacaaccggcaatctggccaagaccttcctgcagctggtggaagataagttccccagcagctccaaggcccagaaggccctgaacgagctcgtgggccctgataccggacctcagaccgaggtgctgaacctgttctttcgggccctgaatggctgctccccccggatcttttctggcgctgagaagaagcagcagctggccagcgtgatcaccaacaccctggatgccatcaacgccgacaacgaggactaccccaagcccggcgacttccccagaagcagctttagcagcaccccccctcatgcccctgtgccccagtctgagatccctaccagcccaaccagcacccagcctccaagccctcaccaccaccatcaccac

SEQ ID NO: 268 - DNA, 1323 bp, Artificial Sequence
  Synthetic Polynucleotide
atggaaacccctgcccagctgctgttcctgctgctgctgtggctgcctgacaccaccggcatgacagcatctggcggagctggcggcctgggctctacacagacagtggatgtggccagggcccaggctgctgccgctacacaggatgcccaggaagtgatcggcagccaggaagccagcgaggcctctatgctgaagggctgcgaggacctgatcaaccctgccgccgctacccgcatcaagaagaaagaggaaaagttcgagtccctggaagccagacggaagcccaccgccgacaaggccgagaagaagtccgagagcaccgaggaaaagggcgacacccccctggaagatcggttcaccgaggatctgagcgaggtgtccggcgaggacttccggggcctgaagaacagcttcgacgacgacagcagccccgaggaaatcctggacgccctgaccagcaagttcagcgaccccaccatcaaggacctggccctggactacctgatccagaccgcccccagcgaccggaagctgaagtctgccctgattcaggccaagcaccagctgatgagccagaacccccaggccatcgtgggcggcagaaatgtgctgctggcctccgagacattcgccagcagagccaacaccgcccccagctccctgcggagcctgtatctgcaagtgaccagctcccccagcaactgcgacaacctgagacagatgctggctagctacctgccctccgagaaaaccgccgtgatggaattcctcgtgaacggcatggtggccgacctgaaaagcgagggccctagcatccctcccgccaagctgcaggtgtacatgaccgagctgagcaacctgcaggccctgcacagcgtggacagctttttcgaccggaacatcggcaacctggaaaacagcctgaagcacgagggccacgcccccatcccttctctgacaaccggcaatctggccaagaccttcctgcagctggtggaagataagttccccagcagctccaaggcccagaaggccctgaacgagctcgtgggccctgataccggacctcagaccgaggtgctgaacctgttctttcgggccctgaatggctgctccccccggatcttttctggcgctgagaagaagcagcagctggccagcgtgatcaccaacaccctggatgccatcaacgccgacaacgaggactaccccaagcccggcgacttccccagaagcagctttagcagcaccccccctcatgcccctgtgccccagtctgagatccctaccagcccaaccagcacccagcctccaagccct

SEQ ID NO: 269 - DNA, 1341 bp, Artificial Sequence
  Synthetic Polynucleotide
atggaaacccctgcccagctgctgttcctgctgctgctgtggctgcctgacaccaccggcatgacagcatctggcggagctggcggcctgggctctacacagacagtggatgtggccagggcccaggctgctgccgctacacaggatgcccaggaagtgatcggcagccaggaagccagcgaggcctctatgctgaagggctgcgaggacctgatcaaccctgccgccgctacccgcatcaagaagaaagaggaaaagttcgagtccctggaagccagacggaagcccaccgccgacaaggccgagaagaagtccgagagcaccgaggaaaagggcgacacccccctggaagatcggttcaccgaggatctgagcgaggtgtccggcgaggacttccggggcctgaagaacagcttcgacgacgacagcagccccgaggaaatcctggacgccctgaccagcaagttcagcgaccccaccatcaaggacctggccctggactacctgatccagaccgcccccagcgaccggaagctgaagtctgccctgattcaggccaagcaccagctgatgagccagaacccccaggccatcgtgggcggcagaaatgtgctgctggcctccgagacattcgccagcagagccaacaccgcccccagctccctgcggagcctgtatctgcaagtgaccagctcccccagcaactgcgacaacctgagacagatgctggctagctacctgccctccgagaaaaccgccgtgatggaattcctcgtgaacggcatggtggccgacctgaaaagcgagggccctagcatccctcccgccaagctgcaggtgtacatgaccgagctgagcaacctgcaggccctgcacagcgtggacagctttttcgaccggaacatcggcaacctggaaaacagcctgaagcacgagggccacgcccccatcccttctctgacaaccggcaatctggccaagaccttcctgcagctggtggaagataagttccccagcagctccaaggcccagaaggccctgaacgagctcgtgggccctgataccggacctcagaccgaggtgctgaacctgttctttcgggccctgaatggctgctccccccggatcttttctggcgctgagaagaagcagcagctggccagcgtgatcaccaacaccctggatgccatcaacgccgacaacgaggactaccccaagcccggcgacttccccagaagcagctttagcagcaccccccctcatgcccctgtgccccagtctgagatccctaccagcccaaccagcacccagcctccaagccctcaccaccaccatcaccac

SEQ ID NO: 270 - DNA, 1323 bp, Artificial Sequence
  Synthetic Polynucleotide
atggaaacccctgcccagctgctgttcctgctgctgctgtggctgcctgacaccaccggcatgacagcatctggcggagctggcggcctgggctctacacagacagtggatgtggccagggcccaggctgctgccgctacacaggatgcccaggaagtgatcggcagccaggaagccagcgaggcctctatgctgaagggctgcgaggacctgatcaaccctgccgccgctacccgcatcaagaagaaagaggaaaagttcgagtccctggaagccagacggaagcccaccgccgacaaggccgagaagaagtccgagagcaccgaggaaaagggcgacacccccctggaagatcggttcaccgaggatctgagcgaggtgtccggcgaggacttccggggcctgaagaacagcttcgacgacgacagcagccccgaggaaatcctggacgccctgaccagcaagttcagcgaccccaccatcaaggacctggccctggactacctgatccagaccgcccccagcgaccggaagctgaagtctgccctgattcaggccaagcaccagctgatgagccagaacccccaggccatcgtgggcggcagaaatgtgctgctggcctccgagacattcgccagcagagccaacaccgcccccagctccctgcggagcctgtatctgcaagtgaccagctcccccagcaactgcgacaacctgagacagatgctggctagctacctgccctccgagaaaaccgccgtgatggaattcctcgtgaacggcatggtggccgacctgaaaagcgagggccctagcatccctcccgccaagctgcaggtgtacatgaccgagctgagcaacctgcaggccctgcacagcgtggacagctttttcgaccggaacatcggcaacctggaaaacagcctgaagcacgagggccacgcccccatcccttctctgacaaccggcaatctgaccaagaccttcctgcagctggtggaagataagttccccagcagctccaaggcccagaaggccctgaacgagctcgtgggccctgataccggacctcagaccgaggtgctgaacctgttctttcgggccctgaatggctgctccccccggatcttttctggcgctgagaagaagcagcagctggccagcgtgatcaccaacaccctggatgccatcaacgccgacaacgaggactaccccaagcccggcgacttccccagaagcagctttagcagcaccccccctcatgcccctgtgccccagtctgagatccctaccagcccaaccagcacccagcctccaagccct

SEQ ID NO: 271 - DNA, 1341 bp, Artificial Sequence
  Synthetic Polynucleotide
atggaaacccctgcccagctgctgttcctgctgctgctgtggctgcctgacaccaccggcatgacagcatctggcggagctggcggcctgggctctacacagacagtggatgtggccagggcccaggctgctgccgctacacaggatgcccaggaagtgatcggcagccaggaagccagcgaggcctctatgctgaagggctgcgaggacctgatcaaccctgccgccgctacccgcatcaagaagaaagaggaaaagttcgagtccctggaagccagacggaagcccaccgccgacaaggccgagaagaagtccgagagcaccgaggaaaagggcgacacccccctggaagatcggttcaccgaggatctgagcgaggtgtccggcgaggacttccggggcctgaagaacagcttcgacgacgacagcagccccgaggaaatcctggacgccctgaccagcaagttcagcgaccccaccatcaaggacctggccctggactacctgatccagaccgcccccagcgaccggaagctgaagtctgccctgattcaggccaagcaccagctgatgagccagaacccccaggccatcgtgggcggcagaaatgtgctgctggcctccgagacattcgccagcagagccaacaccgcccccagctccctgcggagcctgtatctgcaagtgaccagctcccccagcaactgcgacaacctgagacagatgctggctagctacctgccctccgagaaaaccgccgtgatggaattcctcgtgaacggcatggtggccgacctgaaaagcgagggccctagcatccctcccgccaagctgcaggtgtacatgaccgagctgagcaacctgcaggccctgcacagcgtggacagctttttcgaccggaacatcggcaacctggaaaacagcctgaagcacgagggccacgcccccatcccttctctgacaaccggcaatctgaccaagaccttcctgcagctggtggaagataagttccccagcagctccaaggcccagaaggccctgaacgagctcgtgggccctgataccggacctcagaccgaggtgctgaacctgttctttcgggccctgaatggctgctccccccggatcttttctggcgctgagaagaagcagcagctggccagcgtgatcaccaacaccctggatgccatcaacgccgacaacgaggactaccccaagcccggcgacttccccagaagcagctttagcagcaccccccctcatgcccctgtgccccagtctgagatccctaccagcccaaccagcacccagcctccaagccctcaccaccaccatcaccac

SEQ ID NO: 272 - DNA, 1851 bp, Artificial Sequence
  Synthetic Polynucleotide
atggaaacccctgcccagctgctgttcctgctgctgctgtggctgcctgacaccaccggcatgagcatcagaggcgtgggcggcaacggcaacagcagaatccctagccacaacggcgacggcagcaacaggcggagccagaacaccaagggcaacaacaaggtggaagatagagtgtgcagcctgtacagcagccggtccaacgagaaccgcgagagcccttatgccgtggtggacgtgtccagcatgatcgagagcacccccaccagcggcgagacaaccagagctagtagaggcgtgctgagccggttccagaggggcctcgtgcggattgctgacaaagtgcggagagccgtgcagtgcgcttggagcagcgtgtccacaagcagaagcagcgccacaagagccgccgagagcggcagctctagcagaacagctagaggcgccagcagcggctacagagagtacagcccttctgccgctcggggcctgcggctgatgttcaccgacttttggcggacccgggtgctgagacagacctctcctatggccggcgtgttcggcaacctggacgtgaacgaggccagactgatggccgcctacaccagcgagtgtgccgatcacctggaagccaaagagctggccggacctgacggcgtggcagccgctagagaaatcgccaagagatgggagaagagagtgcgggacctgcaggacaagggcgctgccagaaagctgctgaacgaccccctgggcagacggacccccaactaccagagcaagaaccccggcgagtacaccgtgggcaactccatgttctacgacggcccccaggtggccaacctgcagaatgtggataccggcttctggctggacatgagcaacctgagcgacgtggtgctgtccagagagatccagaccggcctgagagccagagccaccctggaagagtccatgcccatgctggaaaatctggaagagagattccggcggctgcaggaaacctgcgacgccgccagaaccgagatcgaggaaagcggctggacccgggaaagcgcctccagaatggaaggcgacgaagcccagggccccagcagagtgcagcaggcctttcagagcttcgtgaatgagtgcaacagcatcgagttcagcttcggctccttcggcgagcacgtgcgggtgctgtgtgccagagtgtcaagaggactggccgctgccggcgaggccatcagaagatgcttcagctgctgcaagggcagcacccacagatacgcccccagagatgacctgtctcctgagggcgcctctctggccgaaaccctggccagattcgccgacgacatgggcatcgaaagaggcgccgacggcacctacgacatccccctggtggacgattggagaaggggcgtgccatccatcgagggcgagggcagcgatagcatctacgagatcatgatgcccatctacgaagtgatgaacatggacctggaaacccggcggagcttcgccgtgcagcagggccattaccaggaccccagagccagcgactacgacctgcctagagcctccgattacgatctgcccagaagcccctaccccacccctccactgcctcccagataccagctgcagaacatggatgtggaagccggctttcgcgaggccgtgtacgcctcttttgtggccggcatgtacaactacgtcgtgacccagccccaggaacggatccccaatagccagcaggtggaaggcatcctgcgggacatgctgaccaacggcagccagaccttccgggacctgatgaagcggtggaacagagaggtggaccgcgagcaccaccatcaccaccac

SEQ ID NO: 273 - DNA, 1179 bp, Artificial Sequence
  Synthetic Polynucleotide
atgaagaaactgctgaagtccgtgctggtgttcgccgccctgtctagcgcaagctctctgcaggctctgcccgtgggaaatcctgccgagcccagcctgatgatcgacggcattctgtgggagggcttcggcggcgacccttgcgatccttgtgctacttggtgcgacgccatcagcatgagagtgggctactacggcgacttcgtgttcgaccgggtgctgaaaaccgacgtgaacaaagaattccagatgggcgccaagcccaccaccgacaccggaaattctgccgcccctagcaccctgaccgccagagagaatcctgcctacggccggcacatgcaggacgccgagatgttcaccaacgccgcctgcatggccctgaacatctgggacagattcgacgtgttctgcaccctgggcgccaccagcggctacctgaaaggcaatagcgccagcttcaacctcgtgggcctgttcggcgacaacgagaaccagaaaaccgtgaaggccgagagcgtgcccaacatgagcttcgaccagagcgtggtggaactgtacaccgataccaccttcgcttggagcgtgggagccagagccgctctgtgggaatgtggctgtgccacactgggggccagcttccagtacgcccagagcaagcccaaggtggaagaactgaacgtgctgtgcaatgccgccgagttcaccatcaacaagcctaagggctacgtgggcaaagagttccccctggatctgaccgccggaaccgatgccgccaccggaacaaaggacgccagcatcgactaccacgagtggcaggcttctctggccctgagctaccggctgaatatgttcaccccctacatcggcgtgaagtggtccagagccagcttcgacgccgacaccatcagaatcgcccagcccaagagcgccaccgccatctttgataccaccaccctgaaccccaccattgccggcgctggcgacgtgaaaacaggcgccgaaggacagctgggcgacacaatgcagatcgtgtccctgcagctgaacaagatgaagtcccggaagtcctgcggaatcgccgtgggcaccacaatcgtggacgccgataagtacgccgtgaccgtggaaacccggctgatcgatgagagggccgctcacgtgaacgcccagttcagattc

SEQ ID NO: 274 - DNA, 2070 bp, Artificial Sequence
  Synthetic Polynucleotide
atggaaacccccgcccaactcctgttccttcttctgctctggctccctgacactactggtgctgagattatgatacctcagggaatctacgacggagagactctgactgtctcgttcccgtataccgtgatcggcgacccctctggcaccaccgtcttttccgccggggagctgaccctgaaaaacctggacaacagcatcgcggccctgcccctgagctgtttcggaaacttgttgggttccttcactgtgctcggacggggtcactccctgacctttgagaatatccggacttcgactaacggcgccgccctgtcggattcagccaactccggactcttcaccatcgaaggcttcaaggaactcagctttagcaattgcaactcgctgctggcggtgctgccagcggctaccactaacaacggatcccaaactcccaccaccacttcgactccgtccaatgggaccatctactccaagaccgatctccttctcctgaacaacgagaagttctccttctactccaacctggtgtccggggatgggggtgccattgacgccaagtcactgacagtgcagggcatctccaagctctgtgtgttccaagaaaacaccgcccaggccgatgggggagcgtgccaggtcgtcacctccttctctgcaatggccaacgaggcccccatcgccttcattgcaaacgtggcgggcgtgcgcggcggcggcattgccgcggtgcaagacggccagcagggagtgtcgtcctcaacctcgaccgaagatccggtcgtgtccttctcccggaatactgccgtggaattcgacggaaacgtggctcgcgtgggaggcggaatctacagctatggaaacgtcgcctttctgaacaacggcaaaacgcttttcctgaacaatgtcgctagccctgtgtacatcgctgccgaacagccgaccaacggacaggcatccaacaccagcgacaactatggcgatggcggcgcgatcttctgcaagaacggggcccaggcggccgggagcaacaactcaggatccgtgtccttcgacggagaaggcgtcgtgttcttctcctcaaacgtggctgccggaaagggtggagccatctacgcgaagaagctctccgtggccaattgcggaccggtccagttcctgggaaacattgccaacgacggaggtgcaatctacctgggagaaagcggagaactgtcgctctccgccgactacggcgatatcatcttcgacggcaacctcaagcggaccgcaaaggagaacgcggcagacgtcaatggagtgaccgtgtcgagccaagccatttcaatgggttccggcgggaagatcaccaccttgagggccaaggccggccaccagattctgttcaacgatcctattgagatggccaacgggaacaaccagcctgcgcagtcctcggaacccctgaagatcaatgacggagagggctacactggagacatcgtgttcgccaacggaaactccaccttgtaccagaacgtgacgattgagcaggggagaattgtgctgagagaaaaagcgaagctgtccgtgaatagcttgagccagaccgggggctcactgtacatggaggccggatccaccctggacttcgtgacaccgcagccaccgcagcagcctcccgccgcgaaccaactgattaccctctcgaaccttcacctgagcctgtcctcactgctggcaaacaacgctgtgactaaccctccaaccaacccgccggcccaggacagccatccggccattatcggctccaccaccgccggttctgtgaccatcagcggcccaatctttttcgaggatctggacgacaccgcttacgaccgctacgattggctgggatccaaccagaagatcgacgtgcttaagctgcaactgggaacgcaaccctccgccaacgccccgtcggacctgaccctggggaacgaaatgcctaagtacggataccaggggagctggaagctcgcctgggatcccaacaccgccaacaacggtccgtacactctgaaggccacctggactaagactggt

SEQ ID NO: 275 - DNA, 2088 bp, Artificial Sequence
  Synthetic Polynucleotide
atggaaacccccgcccaactcctgttccttcttctgctctggctccctgacactactggtgctgagattatgatacctcagggaatctacgacggagagactctgactgtctcgttcccgtataccgtgatcggcgacccctctggcaccaccgtcttttccgccggggagctgaccctgaaaaacctggacaacagcatcgcggccctgcccctgagctgtttcggaaacttgttgggttccttcactgtgctcggacggggtcactccctgacctttgagaatatccggacttcgactaacggcgccgccctgtcggattcagccaactccggactcttcaccatcgaaggcttcaaggaactcagctttagcaattgcaactcgctgctggcggtgctgccagcggctaccactaacaacggatcccaaactcccaccaccacttcgactccgtccaatgggaccatctactccaagaccgatctccttctcctgaacaacgagaagttctccttctactccaacctggtgtccggggatgggggtgccattgacgccaagtcactgacagtgcagggcatctccaagctctgtgtgttccaagaaaacaccgcccaggccgatgggggagcgtgccaggtcgtcacctccttctctgcaatggccaacgaggcccccatcgccttcattgcaaacgtggcgggcgtgcgcggcggcggcattgccgcggtgcaagacggccagcagggagtgtcgtcctcaacctcgaccgaagatccggtcgtgtccttctcccggaatactgccgtggaattcgacggaaacgtggctcgcgtgggaggcggaatctacagctatggaaacgtcgcctttctgaacaacggcaaaacgcttttcctgaacaatgtcgctagccctgtgtacatcgctgccgaacagccgaccaacggacaggcatccaacaccagcgacaactatggcgatggcggcgcgatcttctgcaagaacggggcccaggcggccgggagcaacaactcaggatccgtgtccttcgacggagaaggcgtcgtgttcttctcctcaaacgtggctgccggaaagggtggagccatctacgcgaagaagctctccgtggccaattgcggaccggtccagttcctgggaaacattgccaacgacggaggtgcaatctacctgggagaaagcggagaactgtcgctctccgccgactacggcgatatcatcttcgacggcaacctcaagcggaccgcaaaggagaacgcggcagacgtcaatggagtgaccgtgtcgagccaagccatttcaatgggttccggcgggaagatcaccaccttgagggccaaggccggccaccagattctgttcaacgatcctattgagatggccaacgggaacaaccagcctgcgcagtcctcggaacccctgaagatcaatgacggagagggctacactggagacatcgtgttcgccaacggaaactccaccttgtaccagaacgtgacgattgagcaggggagaattgtgctgagagaaaaagcgaagctgtccgtgaatagcttgagccagaccgggggctcactgtacatggaggccggatccaccctggacttcgtgacaccgcagccaccgcagcagcctcccgccgcgaaccaactgattaccctctcgaaccttcacctgagcctgtcctcactgctggcaaacaacgctgtgactaaccctccaaccaacccgccggcccaggacagccatccggccattatcggctccaccaccgccggttctgtgaccatcagcggcccaatctttttcgaggatctggacgacaccgcttacgaccgctacgattggctgggatccaaccagaagatcgacgtgcttaagctgcaactgggaacgcaaccctccgccaacgccccgtcggacctgaccctggggaacgaaatgcctaagtacggataccaggggagctggaagctcgcctgggatcccaacaccgccaacaacggtccgtacactctgaaggccacctggactaagactggtcaccatcatcaccaccac

SEQ ID NO: 276 - DNA, 2067 bp, Artificial Sequence
  Synthetic Polynucleotide
atggaaacccctgcccaacttctgttcctccttctgctctggctccccgacactaccggtgctgagatcatgattccgcaaggcatctacgacggggaaactctgaccgtgtcctttccatacaccgtcattggtgatccttccggaactaccgtgttctccgcgggcgaactgaccttgaagaatcttgacaattccatcgcggccctgcccctgagctgcttcggcaacttgctgggatcgttcactgtgctggggcgcggacattcgctgactttcgaaaacattagaaccagcaccaacggtgctgcgctttcgaatagcgccgctgatggcttgttcaccatcgagggtttcaaggaactgagcttctccaactgcaactcgctgctcgccgtgctgccggccgctactacgaacaagggcagccagactccgacgacaacctccactccctcaaacggcaccatctactccaagaccgatctgctgctgctcaacaacgagaagttctcattctactccaacctcgtgtccggcgacggaggcgcaattgacgccaagagcctgaccgtgcagggaatctcaaagctgtgcgtctttcaagagaacactgcgcaggcagacggaggagcctgtcaggtcgtgacctccttttccgccatggccaacgaggcccctatcgccttcgtggccaacgtggccggcgtgcggggtggaggaatcgcagccgtgcaagacggccagcagggagtgtctagcagcacttccaccgaggaccccgtggtgtcgttctcccggaacaccgccgtggagttcgatggaaacgtggcgcgcgtggggggaggcatctactcctacgggaacgtcgcctttcttaacaacggaaagaccctgttcctgaacaatgtggcctcgccggtgtacatcgccgccaagcagccaactagcggccaggcctccaacacctccaacaactatggcgacggcggagccatcttctgcaagaacggcgctcaagctggatcgaacaacagcggttctgtctccttcgacggcgaaggagtcgtgtttttctcctccaacgtcgcggccggcaaagggggggccatatacgcgaagaaactgtcagtggcgaactgcggacccgtgcagttcctccggaacattgccaacgacgggggtgcaatctacctgggagagtcaggagaactgagcctctcggcggattacggcgacatcattttcgacggaaatctgaagcggaccgccaaggaaaacgcggcagatgtgaacggggtcaccgtgtcaagccaggccatttctatggggtccggagggaagattaccaccctgcgcgccaaggccggccatcagattctcttcaacgaccctatcgagatggctaatggaaacaatcagcccgcccagtcctccaagctgctgaaaatcaacgacggagaggggtacaccggggatatcgtgttcgccaacggaagctcgactctctaccaaaacgtgaccattgagcaggggaggatcgtgctgagggaaaaggctaagctgtccgtcaactcgctgagccagaccggaggctccctctacatggaagcaggatcgacgctggacttcgtgactccgcaaccaccgcagcagcctcccgccgccaaccagctgatcaccttgtccaatctgcacctgagcctgtcgtccttgctcgccaacaacgccgtgactaaccctcctactaacccgccggcccaggactcgcacccggccgtcatcggatcaaccacagcaggaagcgtgactatctccggtcctatcttcttcgaggacctggatgacaccgcctacgatagatacgattggttgggttccaaccagaagattaacgtgctgaagctgcagctgggaaccaagccaccggcgaacgccccgtccgacctgaccctcggcaacgaaatgcccaaatacggataccagggctcctggaagctcgcgtgggaccccaataccgcgaacaacggtccctatacactcaaggccacttggaccaagaccggc

SEQ ID NO: 277 - DNA, 2085 bp, Artificial Sequence
  Synthetic Polynucleotide
atggaaacccctgcccaacttctgttcctccttctgctctggctccccgacactaccggtgctgagatcatgattccgcaaggcatctacgacggggaaactctgaccgtgtcctttccatacaccgtcattggtgatccttccggaactaccgtgttctccgcgggcgaactgaccttgaagaatcttgacaattccatcgcggccctgcccctgagctgcttcggcaacttgctgggatcgttcactgtgctggggcgcggacattcgctgactttcgaaaacattagaaccagcaccaacggtgctgcgctttcgaatagcgccgctgatggcttgttcaccatcgagggtttcaaggaactgagcttctccaactgcaactcgctgctcgccgtgctgccggccgctactacgaacaagggcagccagactccgacgacaacctccactccctcaaacggcaccatctactccaagaccgatctgctgctgctcaacaacgagaagttctcattctactccaacctcgtgtccggcgacggaggcgcaattgacgccaagagcctgaccgtgcagggaatctcaaagctgtgcgtctttcaagagaacactgcgcaggcagacggaggagcctgtcaggtcgtgacctccttttccgccatggccaacgaggcccctatcgccttcgtggccaacgtggccggcgtgcggggtggaggaatcgcagccgtgcaagacggccagcagggagtgtctagcagcacttccaccgaggaccccgtggtgtcgttctcccggaacaccgccgtggagttcgatggaaacgtggcgcgcgtggggggaggcatctactcctacgggaacgtcgcctttcttaacaacggaaagaccctgttcctgaacaatgtggcctcgccggtgtacatcgccgccaagcagccaactagcggccaggcctccaacacctccaacaactatggcgacggcggagccatcttctgcaagaacggcgctcaagctggatcgaacaacagcggttctgtctccttcgacggcgaaggagtcgtgtttttctcctccaacgtcgcggccggcaaagggggggccatatacgcgaagaaactgtcagtggcgaactgcggacccgtgcagttcctccggaacattgccaacgacgggggtgcaatctacctgggagagtcaggagaactgagcctctcggcggattacggcgacatcattttcgacggaaatctgaagcggaccgccaaggaaaacgcggcagatgtgaacggggtcaccgtgtcaagccaggccatttctatggggtccggagggaagattaccaccctgcgcgccaaggccggccatcagattctcttcaacgaccctatcgagatggctaatggaaacaatcagcccgcccagtcctccaagctgctgaaaatcaacgacggagaggggtacaccggggatatcgtgttcgccaacggaagctcgactctctaccaaaacgtgaccattgagcaggggaggatcgtgctgagggaaaaggctaagctgtccgtcaactcgctgagccagaccggaggctccctctacatggaagcaggatcgacgctggacttcgtgactccgcaaccaccgcagcagcctcccgccgccaaccagctgatcaccttgtccaatctgcacctgagcctgtcgtccttgctcgccaacaacgccgtgactaaccctcctactaacccgccggcccaggactcgcacccggccgtcatcggatcaaccacagcaggaagcgtgactatctccggtcctatcttcttcgaggacctggatgacaccgcctacgatagatacgattggttgggttccaaccagaagattaacgtgctgaagctgcagctgggaaccaagccaccggcgaacgccccgtccgacctgaccctcggcaacgaaatgcccaaatacggataccagggctcctggaagctcgcgtgggaccccaataccgcgaacaacggtccctatacactcaaggccacttggaccaagaccggccaccaccatcaccaccac

SEQ ID NO: 278 - DNA, 3579 bp, Artificial Sequence
  Synthetic Polynucleotide
atggaaactcctgcccaactgttgttccttctgctgctctggttgcccgacaccaccggatcgtgcgtggatctccacgctggcggccagtccgtgaacgagcttgtgtacgtgggcccacaggccgtgcttctgctggaccagatcagagatctcttcgtgggttccaaggactcccaggccgagggacagtaccggctcatcgtcggcgacccttcaagcttccaagagaaggatgccgacactcttccggggaaggtggaacagtccactctgttttccgtgaccaacccagtcgtgtttcaaggggtggaccagcaggaccaggtgtccagccaaggactgatctgttcattcacctcgagcaatttggacagcccccgggacggcgaatcgttccttggcatcgcattcgtgggagactcatccaaagcaggaatcacccttaccgatgtgaaggcgtccctgagcggcgctgctctgtactccaccgaagatctcatcttcgagaagatcaagggtggactggagttcgccagctgctcctcactggaacagggaggagcctgtgccgcccaaagcatcctcatccacgattgccaggggctccaagtgaagcattgtaccactgccgtgaacgccgagggatcatccgctaacgatcacctcggtttcggagggggtgccttcttcgtgaccggttcgctgtcgggagaaaagtcactgtatatgcccgcgggcgacatggtggtcgccaactgcgatggagccatctcattcgagggaaactccgccaacttcgcaaacggcggcgctatcgccgctagcgggaaggtgctgttcgtggctaacgacaagaaaacgtccttcatcgaaaaccgcgccctgtcgggaggtgccattgccgccagctccgacattgccttccaaaactgtgcggaactggtgttcaaaggaaactgcgccatcggcaccgaagataagggaagcctgggggggggcgccatttcctccctcggcaccgtgctgcttcagggaaaccacggcatcacttgtgacaagaacgaaagcgcgtcccaggggggagcgatcttcgggaaaaactgccagatttccgacaacgagggaccggtggtgttcagagactccactgcctgcctgggcggcggagcgatcgcagcacaggaaattgtcagcatccagaacaaccaggccggcatcagcttcgaggggggaaaggcttcgttcggcggaggtattgcctgcggatcgttctcgtccgcgggcggagcctccgtgctcggaaccatcgacatttccaagaacctgggcgctatctcgttttctcgcaccctgtgcactacttccgacctgggtcagatggagtaccagggaggcggagcgctgtttggagagaacatctctctgagcgagaacgcgggagtgctgaccttcaaggacaacattgtgaaaaccttcgcctcaaacggaaagatcctggggggaggcgccatcctggcaaccgggaaggtcgaaatcaccaacaattcagagggtatctccttcactggcaacgcccgggccccccaagccctgccgactcaggaagagttccccctgttctccaagaaggaaggacgccctttgtcatccggctactccggtggtggagcgattctgggtcgggaagtggccatcctgcataatgcggccgtggtgtttgagcaaaacagactccaatgctccgaagaagaggccaccctcctggggtgctgcgggggcggagcagtgcatggcatggattccacttccatcgtgggaaactccagcgtccgcttcggaaacaactacgctatgggacagggagtgtcagggggggccctgctgtccaagaccgtccagttggccggaaacggttcggtggatttctcacgcaatatcgcctcgctgggaggcggcgcgctgcaggcctccgaaggaaattgcgaactggtcgacaacggctacgtgctgttccgggacaaccgcggcagggtgtacggcggagcaatctcgtgccttcggggcgacgtcgtgatctcgggaaataagggacgggtcgagtttaaggacaacatcgctaccaggctctacgtggaggaaactgtggagaaggtggaggaagtggagcctgccccggaacagaaggacaacaacgagctgtcgttcctcggtcgggcagaacagtccttcattactgccgccaaccaggccctgttcgcgtccgaagatggtgacctcagcccggaatccagcatctcctccgaggaactggccaagcggagagaatgcgcgggaggcgcaatctttgcgaagcgggtccggatcgtggacaaccaggaagctgtggtgttcagcaacaacttttccgacatctacggtggtgcaattttcaccggctcactccgggaggaggacaagctggacggccagattcccgaggtgctcatttccggcaatgccggcgacgtggtgttctccggaaactcctccaagagggacgaacacctcccgcataccggaggaggagccatctgcactcagaacctgacgatctcgcagaacaccggcaatgtgctgttctacaacaacgtcgcatgttccggtggcgccgtcagaatcgaggaccacggaaacgtgctgctggaagcattcgggggtgatattgtgttcaagggaaacagcagcttccgggcccagggatcagatgcaatctacttcgccgggaaggagagccacattaccgccctgaacgccaccgagggtcacgccatcgtgttccacgatgccctggtgttcgaaaacctggaggagcgcaagagcgccgaagtgctgcttatcaattcccgcgaaaacccgggctacaccggatccatccggttcctcgaagcggagtcgaaggtcccgcagtgtattcatgtgcaacaggggtccctggaactgcttaacggagccaccctgtgctcctacggctttaagcaggacgcgggcgctaaactggtgctggcggccggcgccaagcttaagatcctcgactccggaaccccggtgcagcaggggcacgctattagcaagcctgaagccgagattgagtcgtcatccgaacccgaaggggcgcactccctgtggatagccaagaacgcgcagaccaccgtgccaatggtcgatatccacacaatctccgtggacctcgccagcttctcgtcgagccagcaggagggaactgtcgaagcgcctcaggtcatcgtgccgggaggttcctacgtgcgctcgggggagctcaacctggaactcgtgaataccactggaacgggatatgagaaccacgccctgctgaagaacgaagccaaagtgccactgatgtccttcgtcgcctccggcgacgaggcctccgccgagattagcaacctgtcggtgtcagatctgcaaattcacgtggtgacccctgagattgaggaggacacctacgggcacatgggcgattggtccgaggcgaagatccaggacggcacactggtcatttcatggaaccctaccgga

SEQ ID NO: 279 - DNA, 3597 bp, Artificial Sequence
  Synthetic Polynucleotide
atggaaactcctgcccaactgttgttccttctgctgctctggttgcccgacaccaccggatcgtgcgtggatctccacgctggcggccagtccgtgaacgagcttgtgtacgtgggcccacaggccgtgcttctgctggaccagatcagagatctcttcgtgggttccaaggactcccaggccgagggacagtaccggctcatcgtcggcgacccttcaagcttccaagagaaggatgccgacactcttccggggaaggtggaacagtccactctgttttccgtgaccaacccagtcgtgtttcaaggggtggaccagcaggaccaggtgtccagccaaggactgatctgttcattcacctcgagcaatttggacagcccccgggacggcgaatcgttccttggcatcgcattcgtgggagactcatccaaagcaggaatcacccttaccgatgtgaaggcgtccctgagcggcgctgctctgtactccaccgaagatctcatcttcgagaagatcaagggtggactggagttcgccagctgctcctcactggaacagggaggagcctgtgccgcccaaagcatcctcatccacgattgccaggggctccaagtgaagcattgtaccactgccgtgaacgccgagggatcatccgctaacgatcacctcggtttcggagggggtgccttcttcgtgaccggttcgctgtcgggagaaaagtcactgtatatgcccgcgggcgacatggtggtcgccaactgcgatggagccatctcattcgagggaaactccgccaacttcgcaaacggcggcgctatcgccgctagcgggaaggtgctgttcgtggctaacgacaagaaaacgtccttcatcgaaaaccgcgccctgtcgggaggtgccattgccgccagctccgacattgccttccaaaactgtgcggaactggtgttcaaaggaaactgcgccatcggcaccgaagataagggaagcctgggggggggcgccatttcctccctcggcaccgtgctgcttcagggaaaccacggcatcacttgtgacaagaacgaaagcgcgtcccaggggggagcgatcttcgggaaaaactgccagatttccgacaacgagggaccggtggtgttcagagactccactgcctgcctgggcggcggagcgatcgcagcacaggaaattgtcagcatccagaacaaccaggccggcatcagcttcgaggggggaaaggcttcgttcggcggaggtattgcctgcggatcgttctcgtccgcgggcggagcctccgtgctcggaaccatcgacatttccaagaacctgggcgctatctcgttttctcgcaccctgtgcactacttccgacctgggtcagatggagtaccagggaggcggagcgctgtttggagagaacatctctctgagcgagaacgcgggagtgctgaccttcaaggacaacattgtgaaaaccttcgcctcaaacggaaagatcctggggggaggcgccatcctggcaaccgggaaggtcgaaatcaccaacaattcagagggtatctccttcactggcaacgcccgggccccccaagccctgccgactcaggaagagttccccctgttctccaagaaggaaggacgccctttgtcatccggctactccggtggtggagcgattctgggtcgggaagtggccatcctgcataatgcggccgtggtgtttgagcaaaacagactccaatgctccgaagaagaggccaccctcctggggtgctgcgggggcggagcagtgcatggcatggattccacttccatcgtgggaaactccagcgtccgcttcggaaacaactacgctatgggacagggagtgtcagggggggccctgctgtccaagaccgtccagttggccggaaacggttcggtggatttctcacgcaatatcgcctcgctgggaggcggcgcgctgcaggcctccgaaggaaattgcgaactggtcgacaacggctacgtgctgttccgggacaaccgcggcagggtgtacggcggagcaatctcgtgccttcggggcgacgtcgtgatctcgggaaataagggacgggtcgagtttaaggacaacatcgctaccaggctctacgtggaggaaactgtggagaaggtggaggaagtggagcctgccccggaacagaaggacaacaacgagctgtcgttcctcggtagagccgaacagtccttcattactgccgccaaccaggccctgttcgcgtccgaagatggtgacctcagcccggaatccagcatctcctccgaggaactggccaagcggagagaatgcgcgggaggcgcaatctttgcgaagcgggtccggatcgtggacaaccaggaagctgtggtgttcagcaacaacttttccgacatctacggtggtgcaattttcaccggctcactccgggaggaggacaagctggacggccagattcccgaggtgctcatttccggcaatgccggcgacgtggtgttctccggaaactcctccaagagggacgaacacctcccgcataccggaggaggagccatctgcactcagaacctgacgatctcgcagaacaccggcaatgtgctgttctacaacaacgtcgcatgttccggtggcgccgtcagaatcgaggaccacggaaacgtgctgctggaagcattcgggggtgatattgtgttcaagggaaacagcagcttccgggcccagggatcagatgcaatctacttcgccgggaaggagagccacattaccgccctgaacgccaccgagggtcacgccatcgtgttccacgatgccctggtgttcgaaaacctggaggagcgcaagagcgccgaagtgctgcttatcaattcccgcgaaaacccgggctacaccggatccatccggttcctcgaagcggagtcgaaggtcccgcagtgtattcatgtgcaacaggggtccctggaactgcttaacggagccaccctgtgctcctacggctttaagcaggacgcgggcgctaaactggtgctggcggccggcgccaagcttaagatcctcgactccggaaccccggtgcagcaggggcacgctattagcaagcctgaagccgagattgagtcgtcatccgaacccgaaggggcgcactccctgtggatagccaagaacgcgcagaccaccgtgccaatggtcgatatccacacaatctccgtggacctcgccagcttctcgtcgagccagcaggagggaactgtcgaagcgcctcaggtcatcgtgccgggaggttcctacgtgcgctcgggggagctcaacctggaactcgtgaataccactggaacgggatatgagaaccacgccctgctgaagaacgaagccaaagtgccactgatgtccttcgtcgcctccggggacgaggcctccgccgagattagcaacctgtcggtgtcagatctgcaaattcacgtggtcacccctgagattgaggaggacacctacgggcacatgggcgattggtccgaggcgaagatccaggacggcacactggtcatttcatggaaccctaccggacatcaccaccaccatcac

SEQ ID NO: 280 - DNA, 3576 bp, Artificial Sequence
  Synthetic Polynucleotide
atggaaactcctgcccaactgttgttccttctgctgctctggttgcccgacaccaccggatcgtgcgtggatctccacgctggcggccagtccgtgaacgagcttgtgtacgtgggcccacaggccgtgcttctgctggaccagatcagagatctcttcgtgggttccaaggactcccaggccgagggacagtaccggctcatcgtcggcgacccttcaagcttccaagagaaggatgccgacactcttccggggaaggtggaacagtccactctgttttccgtgaccaacccagtcgtgtttcaaggggtggaccagcaggaccaggtgtccagccaaggactgatctgttcattcacctcgagcaatttggacagcccccgggacggcgaatcgttccttggcatcgcattcgtgggagactcatccaaagcaggaatcacccttaccgatgtgaaggcgtccctgagcggcgctgctctgtactccaccgaagatctcatcttcgagaagatcaagggtggactggagttcgccagctgctcctcactggaacagggaggagcctgtgccgcccaaagcatcctcatccacgattgccaggggctccaagtgaagcattgtaccactgccgtgaacgccgagggatcatccgctaacgatcacctcggtttcggagggggtgccttcttcgtgaccggttcgctgtcgggagaaaagtcactgtatatgcccgcgggcgacatggtggtcgccaactgcgatggagccatctcattcgagggaaactccgccaacttcgcaaacggcggcgctatcgccgctagcgggaaggtgctgttcgtggctaacgacaagaaaacgtccttcatcgaaaaccgcgccctgtcgggaggtgccattgccgccagctccgacattgccttccaaaactgtgcggaactggtgttcaaaggaaactgcgccatcggcaccgaagataagggaagcctgggggggggcgccatttcctccctcggcaccgtgctgcttcagggaaaccacggcatcacttgtgacaagaacgaaagcgcgtcccaggggggagcgatcttcgggaaaaactgccagatttccgacaacgagggaccggtggtgttcagagactccactgcctgcctgggcggcggagcgatcgcagcacaggaaattgtcagcatccagaacaaccaggccggcatcagcttcgaggggggaaaggcttcgttcggcggaggtattgcctgcggatcgttctcgtccgcgggcggagcctccgtgctcggaaccatcgacatttccaagaacctgggcgctatctcgttttctcgcaccctgtgcactacttccgacctgggtcagatggagtaccagggaggcggagcgctgtttggagagaacatctctctgagcgagaacgcgggagtgctgaccttcaaggacaacattgtgaaaaccttcgcctcaaacggaaagatcctggggggaggcgccatcctggcaaccgggaaggtcgaaatcaccaacaattcaggcggtatctccttcactggcaacgcccgggccccccaagccctgccgactcaggaagagttccccctgttctccaagaaggaaggacgccctttgtcatccggctactccggtggtggagcgattctgggtcgggaagtggccatcctgcataatgcggccgtggtgtttgagcaaaacagactccaatgctccgaagaagaggccaccctcctggggtgctgcgggggcggagcagtgcatggcatggattccacttccatcgtgggaaactccagcgtccgcttcggaaacaactacgctatgggacagggagtgtcagggggggccctgctgtccaagaccgtccagttggccggaaacggttcggtggatttctcacgcaatatcgcctcgctgggaggcggcgcgctgcaggcctccgaaggaaattgcgaactggtcgacaacggctacgtgctgttccgggacaaccgcggcagggtgtacggcggagcaatctcgtgccttcggggcgacgtcgtgatctcgggaaataagggacgggtcgagtttaaggacaacatcgctaccaggctctacgtggaggaaactgtggagaaggtggaggaagtggagcctgccccggaacagaaggacaacaacgagctgtcgttcctcggttccgtcgaacagtccttcattactgccgccaaccaggccctgttcgcgtccgaagatggtgacctcagcccggaatccagcatctcctccgaggaactggccaagcggagagaatgcgcgggaggcgcaatctttgcgaagcgggtccggatcgtggacaaccaggaagctgtggtgttcagcaacaacttttccgacatctacggtggtgcaattttcaccggctcactccgggaggaggacaagctggacggccagattcccgaggtgctcatttccggcaatgccggcgacgtggtgttctccggaaactcctccaagagggacgaacacctcccgcataccggaggaggagccatctgcactcagaacctgacgatctcgcagaacaccggcaatgtgctgttctacaacaacgtcgcatgttccggtggcgccgtcagaatcgaggaccacggaaacgtgctgctggaagcattcgggggtgatattgtgttcaagggaaacagcagcttccgggcccagggatcagatgcaatctacttcgccgggaaggagagccacattaccgccctgaacgccaccgagggtcacgccatcgtgttccacgatgccctggtgttcgaaaacctgaaggagcgcaagagcgccgaagtgctgcttatcaattcccgcgaaaacccgggctacaccggatccatccggttcctcgaagcggagtcgaaggtcccgcagtgtattcatgtgcaacaggggtccctggaactgcttaacggagccaccctgtgctcctacggctttaagcaggacgcgggcgctaaactggtgctggcggccggctccaagcttaagatcctcgactccggaaccccggtgcaggggcacgctattagcaagcctgaagccgagattgagtcgtcatccgaacccgaaggggcgcactccctgtggatagccaagaacgcgcagaccaccgtgccaatggtcgatatccacacaatctccgtggacctcgccagcttctcgtcgagccagcaggagggaactgtcgaagcgcctcaggtcatcgtgccgggaggttcctacgtgcgctcgggggagctcaacctggaactcgtgaataccactggaacgggatatgagaaccacgccctgctgaagaacgaagccaaagtgccactgatgtccttcgtcgcctcctccgacgaggcctccgccgagattagcaacctgtcggtgtcagatctgcaaattcacgtggccacccctgagattgaggaggacacctacgggcacatgggcgattggtccgaggcgaagatccaggacggcacactggtcatttcatggaaccctaccgga

SEQ ID NO: 281 - DNA, 3594 bp, Artificial Sequence
  Synthetic Polynucleotide
atggaaactcctgcccaactgttgttccttctgctgctctggttgcccgacaccaccggatcgtgcgtggatctccacgctggcggccagtccgtgaacgagcttgtgtacgtgggcccacaggccgtgcttctgctggaccagatcagagatctcttcgtgggttccaaggactcccaggccgagggacagtaccggctcatcgtcggcgacccttcaagcttccaagagaaggatgccgacactcttccggggaaggtggaacagtccactctgttttccgtgaccaacccagtcgtgtttcaaggggtggaccagcaggaccaggtgtccagccaaggactgatctgttcattcacctcgagcaatttggacagcccccgggacggcgaatcgttccttggcatcgcattcgtgggagactcatccaaagcaggaatcacccttaccgatgtgaaggcgtccctgagcggcgctgctctgtactccaccgaagatctcatcttcgagaagatcaagggtggactggagttcgccagctgctcctcactggaacagggaggagcctgtgccgcccaaagcatcctcatccacgattgccaggggctccaagtgaagcattgtaccactgccgtgaacgccgagggatcatccgctaacgatcacctcggtttcggagggggtgccttcttcgtgaccggttcgctgtcgggagaaaagtcactgtatatgcccgcgggcgacatggtggtcgccaactgcgatggagccatctcattcgagggaaactccgccaacttcgcaaacggcggcgctatcgccgctagcgggaaggtgctgttcgtggctaacgacaagaaaacgtccttcatcgaaaaccgcgccctgtcgggaggtgccattgccgccagctccgacattgccttccaaaactgtgcggaactggtgttcaaaggaaactgcgccatcggcaccgaagataagggaagcctgggggggggcgccatttcctccctcggcaccgtgctgcttcagggaaaccacggcatcacttgtgacaagaacgaaagcgcgtcccaggggggagcgatcttcgggaaaaactgccagatttccgacaacgagggaccggtggtgttcagagactccactgcctgcctgggcggcggagcgatcgcagcacaggaaattgtcagcatccagaacaaccaggccggcatcagcttcgaggggggaaaggcttcgttcggcggaggtattgcctgcggatcgttctcgtccgcgggcggagcctccgtgctcggaaccatcgacatttccaagaacctgggcgctatctcgttttctcgcaccctgtgcactacttccgacctgggtcagatggagtaccagggaggcggagcgctgtttggagagaacatctctctgagcgagaacgcgggagtgctgaccttcaaggacaacattgtgaaaaccttcgcctcaaacggaaagatcctggggggaggcgccatcctggcaaccgggaaggtcgaaatcaccaacaattcaggcggtatctccttcactggcaacgcccgggccccccaagccctgccgactcaggaagagttccccctgttctccaagaaggaaggacgccctttgtcatccggctactccggtggtggagcgattctgggtcgggaagtggccatcctgcataatgcggccgtggtgtttgagcaaaacagactccaatgctccgaagaagaggccaccctcctggggtgctgcgggggcggagcagtgcatggcatggattccacttccatcgtgggaaactccagcgtccgcttcggaaacaactacgctatgggacagggagtgtcagggggggccctgctgtccaagaccgtccagttggccggaaacggttcggtggatttctcacgcaatatcgcctcgctgggaggcggcgcgctgcaggcctccgaaggaaattgcgaactggtcgacaacggctacgtgctgttccgggacaaccgcggcagggtgtacggcggagcaatctcgtgccttcggggcgacgtcgtgatctcgggaaataagggacgggtcgagtttaaggacaacatcgctaccaggctctacgtggaggaaactgtggagaaggtggaggaagtggagcctgccccggaacagaaggacaacaacgagctgtcgttcctcggttccgtcgaacagtccttcattactgccgccaaccaggccctgttcgcgtccgaagatggtgacctcagcccggaatccagcatctcctccgaggaactggccaagcggagagaatgcgcgggaggcgcaatctttgcgaagcgggtccggatcgtggacaaccaggaagctgtggtgttcagcaacaacttttccgacatctacggtggtgcaattttcaccggctcactccgggaggaggacaagctggacggccagattcccgaggtgctcatttccggcaatgccggcgacgtggtgttctccggaaactcctccaagagggacgaacacctcccgcataccggaggaggagccatctgcactcagaacctgacgatctcgcagaacaccggcaatgtgctgttctacaacaacgtcgcatgttccggtggcgccgtcagaatcgaggaccacggaaacgtgctgctggaagcattcgggggtgatattgtgttcaagggaaacagcagcttccgggcccagggatcagatgcaatctacttcgccgggaaggagagccacattaccgccctgaacgccaccgagggtcacgccatcgtgttccacgatgccctggtgttcgaaaacctgaaggagcgcaagagcgccgaagtgctgcttatcaattcccgcgaaaacccgggctacaccggatccatccggttcctcgaagcggagtcgaaggtcccgcagtgtattcatgtgcaacaggggtccctggaactgcttaacggagccaccctgtgctcctacggctttaagcaggacgcgggcgctaaactggtgctggcggccggctccaagcttaagatcctcgactccggaaccccggtgcaggggcacgctattagcaagcctgaagccgagattgagtcgtcatccgaacccgaaggggcgcactccctgtggatagccaagaacgcgcagaccaccgtgccaatggtcgatatccacacaatctccgtggacctcgccagcttctcgtcgagccagcaggagggaactgtcgaagcgcctcaggtcatcgtgccgggaggttcctacgtgcgctcgggggagctcaacctggaactcgtgaataccactggaacgggatatgagaaccacgccctgctgaagaacgaagccaaagtgccactgatgtccttcgtcgcctcctccgacgaggcctccgccgagattagcaacctgtcggtgtcagatctgcaaattcacgtggccacccctgagattgaggaggacacctacgggcacatgggcgattggtccgaggcgaagatccaggacggcacactggtcatttcatggaaccctaccggacatcaccaccaccatcac

SEQ ID NO: 282 - DNA, 318 bp, Artificial Sequence
  Synthetic Polynucleotide
atggaaactcctgcccaactcctgttcttgctgctgctttggctccctgacactaccggaatgagccagaacaagaactcggcattcatgcagccggtcaatgtgtccgccgatctggccgccattgtgggagctgggcccatgccacggaccgaaatcatcaaaaagatgtgggactacattaagaagaacggcctgcaggacccgaccaacaagcgcaacatcaacccggacgataagctggcgaaggtgttcggtaccgagaagcccatcgacatgtttcaaatgaccaagatggtgtcccagcacatcattaag

SEQ ID NO: 283 - DNA, 336 bp, Artificial Sequence
  Synthetic Polynucleotide
atggaaactcctgcccaactcctgttcttgctgctgctttggctccctgacactaccggaatgagccagaacaagaactcggcattcatgcagccggtcaatgtgtccgccgatctggccgccattgtgggagctgggcccatgccacggaccgaaatcatcaaaaagatgtgggactacattaagaagaacggcctgcaggacccgaccaacaagcgcaacatcaacccggacgataagctggcgaaggtgttcggtaccgagaagcccatcgacatgtttcaaatgaccaagatggtgtcccagcacatcattaagcaccaccaccatcaccat

SEQ ID NO: 284 - DNA, 318 bp, Artificial Sequence
  Synthetic Polynucleotide
atggaaactcctgcccaactgttgttcctgctgcttctctggctccctgacactaccggaatgtcgcagaacaagaactccgccttcatgcaacccgtgaacgtgtcagcggacctggcagctattgtcggtgccgggccgatgccccgcaccgaaatcatcaagaagatgtgggactacatcaaggagaacagcctgcaggatccaaccaacaagcggaatatcaacccggacgataagctggccaaagtgttcggcaccgagaagccgattgacatgtttcagatgaccaagatggtgtcccagcacatcattaag

SEQ ID NO: 285 - DNA, 336 bp, Artificial Sequence
  Synthetic Polynucleotide
atggaaactcctgcccaactgttgttcctgctgcttctctggctccctgacactaccggaatgtcgcagaacaagaactccgccttcatgcaacccgtgaacgtgtcagcggacctggcagctattgtcggtgccgggccgatgccccgcaccgaaatcatcaagaagatgtgggactacatcaaggagaacagcctgcaggatccaaccaacaagcggaatatcaacccggacgataagctggccaaagtgttcggcaccgagaagccgattgacatgtttcagatgaccaagatggtgtcccagcacatcattaagcaccaccaccatcatcac

SEQ ID NO: 286 - DNA, 2019 bp, Artificial Sequence
  Synthetic Polynucleotide
atggaaacccctgcccaactgcttttcttgctgctgctctggctccctgacaccaccggaatggaatctggacccgagtccgtgtcaagcaaccagtcctccatgaaccccatcattaatggacagatcgcatccaattccgaaaccaaggaaagcaccaaggcatcggaggcctccccatccgcctcaagctccgtgtcgtcctggtcgtttctgtcgagcgcgaagaatgccctgatctcactgcgggacgcgattctgaacaagaacagctccccaaccgactccctgagccaactcgaggcctcaacttccacttcgactgtgactagggtcgctgccaaggattatgacgaggccaagagcaacttcgacaccgccaagagcggactggaaaacgccaaaaccctggccgaatacgaaactaagatggccgatctcatggcggccctgcaagacatggaacggctggcgaactccgatccgtccaacaaccacactgaggaagtgaacaacatcaagaaggctctcgaggcccagaaggataccatcgacaagttgaacaagcttgtgacgctgcagaaccaaaacaagtccctgacggaagtgctcaaaaccaccgactcggccgaccagattccggccatcaacagccagctggagattaacaagaactcggccgatcagattatcaaggacctggagcgccagaacatttcctacgaggccgtcttgactaacgccggcgaagtgatcaaggcgtcatccgaagccggcattaagctgggacaggcgctgcaatccatcgtcgacgccggcgaccagtcccaggcggcggtgctgcaggcccagcagaacaactcccccgataacatcgctgcaaccaaggaactgattgacgcggccgaaaccaaagtcaacgaactgaagcaggagcacactggtctgaccgactcgccgctcgtgaagaaggccgaagaacagatcagccaggctcagaaggatatccaggaaatcaagccttcggggagcgacatcccgatcgtgggaccgtccggttccgccgcttccgccgggtccgcagccggggcccttaagtcgtcgaacaatagcggcagaatatccctgctgctcgacgatgtggataacgagatggccgccattgcgctgcaaggattccggtccatgatcgagcagttcaacgtgaacaaccccgccaccgccaaggagctgcaggctatggaggcccaactcactgccatgtccgaccagctcgtgggagcggacggagaactgccagccgagatccaggccatcaaggacgctctggcccaggcactgaagcagccgtccgcggatggcctggccaccgccatgggccaggtcgcgttcgccgccgctaaagtcggcggaggttcggccggcactgccgggaccgtgcagatgaatgtcaagcagctgtacaagactgcgttctcgtcgaccagctccagctcctacgccgcggccctgtccgacggttacagcgcgtacaagaccctgaactccctttactccgaatcgagatccggggtccagtccgcaatttcacaaaccgccaatcctgccctgtcgcgctcagtgtcacgcagcggcatcgagtcacagggcagaagcgccgacgctagccaaagggccgcagaaaccattgtgcgggactcccagacacttggagatgtctacagccgcctccaagtgctggactccctcatgtccaccatcgtgtcaaaccctcaggctaaccaggaggaaatcatgcagaagctgaccgcaagcatttccaaggctccgcagtttggataccccgctgtgcaaaactccgcggacagcttgcagaaattcgcagcccagttggagagggagttcgtggacggggagcggtccctcgcggagtcccaggagaacgcattccggaagcagcccgccttcattcaacaagtgcttgtgaacatcgcctccctgttctccggttacctgtct

SEQ ID NO: 287 - DNA, 2037 bp, Artificial Sequence
  Synthetic Polynucleotide
atggaaacccctgcccaactgcttttcttgctgctgctctggctccctgacaccaccggaatggaatctggacccgagtccgtgtcaagcaaccagtcctccatgaaccccatcattaatggacagatcgcatccaattccgaaaccaaggaaagcaccaaggcatcggaggcctccccatccgcctcaagctccgtgtcgtcctggtcgtttctgtcgagcgcgaagaatgccctgatctcactgcgggacgcgattctgaacaagaacagctccccaaccgactccctgagccaactcgaggcctcaacttccacttcgactgtgactagggtcgctgccaaggattatgacgaggccaagagcaacttcgacaccgccaagagcggactggaaaacgccaaaaccctggccgaatacgaaactaagatggccgatctcatggcggccctgcaagacatggaacggctggcgaactccgatccgtccaacaaccacactgaggaagtgaacaacatcaagaaggctctcgaggcccagaaggataccatcgacaagttgaacaagcttgtgacgctgcagaaccaaaacaagtccctgacggaagtgctcaaaaccaccgactcggccgaccagattccggccatcaacagccagctggagattaacaagaactcggccgatcagattatcaaggacctggagcgccagaacatttcctacgaggccgtcttgactaacgccggcgaagtgatcaaggcgtcatccgaagccggcattaagctgggacaggcgctgcaatccatcgtcgacgccggcgaccagtcccaggcggcggtgctgcaggcccagcagaacaactcccccgataacatcgctgcaaccaaggaactgattgacgcggccgaaaccaaagtcaacgaactgaagcaggagcacactggtctgaccgactcgccgctcgtgaagaaggccgaagaacagatcagccaggctcagaaggatatccaggaaatcaagccttcggggagcgacatcccgatcgtgggaccgtccggttccgccgcttccgccgggtccgcagccggggcccttaagtcgtcgaacaatagcggcagaatatccctgctgctcgacgatgtggataacgagatggccgccattgcgctgcaaggattccggtccatgatcgagcagttcaacgtgaacaaccccgccaccgccaaggagctgcaggctatggaggcccaactcactgccatgtccgaccagctcgtgggagcggacggagaactgccagccgagatccaggccatcaaggacgctctggcccaggcactgaagcagccgtccgcggatggcctggccaccgccatgggccaggtcgcgttcgccgccgctaaagtcggcggaggttcggccggcactgccgggaccgtgcagatgaatgtcaagcagctgtacaagactgcgttctcgtcgaccagctccagctcctacgccgcggccctgtccgacggttacagcgcgtacaagaccctgaactccctttactccgaatcgagatccggggtccagtccgcaatttcacaaaccgccaatcctgccctgtcgcgctcagtgtcacgcagcggcatcgagtcacagggcagaagcgccgacgctagccaaagggccgcagaaaccattgtgcgggactcccagacacttggagatgtctacagccgcctccaagtgctggactccctcatgtccaccatcgtgtcaaaccctcaggctaaccaggaggaaatcatgcagaagctgaccgcaagcatttccaaggctccgcagtttggataccccgctgtgcaaaactccgcggacagcttgcagaaattcgcagcccagttggagagggagttcgtggacggggagcggtccctcgcggagtcccaggagaacgcattccggaagcagcccgccttcattcaacaagtgcttgtgaacatcgcctccctgttctccggttacctgtctcatcaccaccaccatcac

SEQ ID NO: 288 - DNA, 1803 bp, Artificial Sequence
  Synthetic Polynucleotide
atggaaacccctgcccagctgctgttcctgctgctgctgtggctgcctgataccacaggcgtgcggggagagtccctcgtgtgcaagaatgccctgcaggacctgagcttcctggaacatctgctgcaagtgaagtacgcccccaagacctggaaagagcagtacctgggctgggacctggtgcagtcctctgtgtctgcccagcagaagctgcggacccaggaaaacccctctaccagcttctgtcagcaagtgctggccgacttcatcggcggcctgaacgatttccatgccggcgtgacctttttcgccatcgagagcgcctacctgccctacaccgtgcagaagtccagcgacggccggttctacttcgtggacatcatgaccttcagcagcgagatcagagtgggcgacgagctgctggaagtggatggcgctcctgtgcaggatgtgctggccacactgtacggcagcaaccacaagggcacagccgccgaagaatctgccgccctgagaaccctgttcagccggatggcctctctgggccacaaggtgccaagcggcagaaccaccctgaagatcagacggccctttggcaccacccgggaagtgcgcgtgaagtggcgctatgtgcctgagggcgtgggcgacctggccacaatcgccccttctatcagagccccccagctgcagaaatccatgcggtcattcttcccaaagaaggacgacgccttccaccggtccagcagcctgttctacagccctatggtgccccacttctgggccgagctgagaaaccactacgccacctccggcctgaagtccggctacaacatcggcagcaccgacggctttctgcccgtgatcggacccgtgatctgggagagcgagggcctgttcagagcctacatcagcagcgtgaccgacggcgacggcaagagccacaaagtgggctttctgagaatccccacctacagctggcaggacatggaagatttcgaccccagcggcccacccccctgggaggaatttgccaagatcatccaggtgttcagcagcaacaccgaggccctgatcatcgaccagaccaacaaccctggcggcagcgtgctgtacctgtacgccctgctgagcatgctgaccgacagacccctggaactgcccaagcaccggatgatcctgacccaggacgaggtggtggacgccctggattggctgaccctgctggaaaacgtggacaccaacgtggaaagccggctggccctgggcgacaacatggaaggctacacagtggatctgcaggtggccgagtacctgaaaagcttcggcagacaggtgctgaactgctggtccaagggcgacatcgagctgagcacccccatccccctgttcggcttcgagaagatccacccccaccccagagtgcagtacagcaagcccatctgcgtgctgatcaacgagcaggacttctcctgcgccgacttcttcccagtggtgctgaaggacaacgacagagccctgatcgtgggcaccagaacagctggcgctggcggcttcgtgttcaacgtgcagttccccaaccggaccggcatcaagacctgtagcctgacaggctctctggccgtgcgggaacacggcgccttcatcgagaacatcggcgtggaaccccacatcgacctgcctttcaccgccaacgacatccggtacaagggctactctgagtacctggacaaagtgaagaaactcgtgtgccagctgattaacaacgacggcaccatcatcctggccgaggacggcagcttc

SEQ ID NO: 289 - DNA, 1821 bp, Artificial Sequence
  Synthetic Polynucleotide
atggaaacccctgcccagctgctgttcctgctgctgctgtggctgcctgataccacaggcgtgcggggagagtccctcgtgtgcaagaatgccctgcaggacctgagcttcctggaacatctgctgcaagtgaagtacgcccccaagacctggaaagagcagtacctgggctgggacctggtgcagtcctctgtgtctgcccagcagaagctgcggacccaggaaaacccctctaccagcttctgtcagcaagtgctggccgacttcatcggcggcctgaacgatttccatgccggcgtgacctttttcgccatcgagagcgcctacctgccctacaccgtgcagaagtccagcgacggccggttctacttcgtggacatcatgaccttcagcagcgagatcagagtgggcgacgagctgctggaagtggatggcgctcctgtgcaggatgtgctggccacactgtacggcagcaaccacaagggcacagccgccgaagaatctgccgccctgagaaccctgttcagccggatggcctctctgggccacaaggtgccaagcggcagaaccaccctgaagatcagacggccctttggcaccacccgggaagtgcgcgtgaagtggcgctatgtgcctgagggcgtgggcgacctggccacaatcgccccttctatcagagccccccagctgcagaaatccatgcggtcattcttcccaaagaaggacgacgccttccaccggtccagcagcctgttctacagccctatggtgccccacttctgggccgagctgagaaaccactacgccacctccggcctgaagtccggctacaacatcggcagcaccgacggctttctgcccgtgatcggacccgtgatctgggagagcgagggcctgttcagagcctacatcagcagcgtgaccgacggcgacggcaagagccacaaagtgggctttctgagaatccccacctacagctggcaggacatggaagatttcgaccccagcggcccacccccctgggaggaatttgccaagatcatccaggtgttcagcagcaacaccgaggccctgatcatcgaccagaccaacaaccctggcggcagcgtgctgtacctgtacgccctgctgagcatgctgaccgacagacccctggaactgcccaagcaccggatgatcctgacccaggacgaggtggtggacgccctggattggctgaccctgctggaaaacgtggacaccaacgtggaaagccggctggccctgggcgacaacatggaaggctacacagtggatctgcaggtggccgagtacctgaaaagcttcggcagacaggtgctgaactgctggtccaagggcgacatcgagctgagcacccccatccccctgttcggcttcgagaagatccacccccaccccagagtgcagtacagcaagcccatctgcgtgctgatcaacgagcaggacttctcctgcgccgacttcttcccagtggtgctgaaggacaacgacagagccctgatcgtgggcaccagaacagctggcgctggcggcttcgtgttcaacgtgcagttccccaaccggaccggcatcaagacctgtagcctgacaggctctctggccgtgcgggaacacggcgccttcatcgagaacatcggcgtggaaccccacatcgacctgcctttcaccgccaacgacatccggtacaagggctactctgagtacctggacaaagtgaagaaactcgtgtgccagctgattaacaacgacggcaccatcatcctggccgaggacggcagcttccaccaccaccatcaccac

SEQ ID NO: 290 - DNA, 1833 bp, Artificial Sequence
  Synthetic Polynucleotide
atggaaacccctgcccagctgctgttcctgctgctgctgtggctgcctgacaccaccggcatgagcatcagaggcgtgggcggcaacggcaacagcagaatccctagccacaacggcgacggcagcaacaggcggagccagaacaccaagggcaacaacaaggtggaagatagagtgtgcagcctgtacagcagccggtccaacgagaaccgcgagagcccttatgccgtggtggacgtgtccagcatgatcgagagcacccccaccagcggcgagacaaccagagctagtagaggcgtgctgagccggttccagaggggcctcgtgcggattgctgacaaagtgcggagagccgtgcagtgcgcttggagcagcgtgtccacaagcagaagcagcgccacaagagccgccgagagcggcagctctagcagaacagctagaggcgccagcagcggctacagagagtacagcccttctgccgctcggggcctgcggctgatgttcaccgacttttggcggacccgggtgctgagacagacctctcctatggccggcgtgttcggcaacctggacgtgaacgaggccagactgatggccgcctacaccagcgagtgtgccgatcacctggaagccaaagagctggccggacctgacggcgtggcagccgctagagaaatcgccaagagatgggagaagagagtgcgggacctgcaggacaagggcgctgccagaaagctgctgaacgaccccctgggcagacggacccccaactaccagagcaagaaccccggcgagtacaccgtgggcaactccatgttctacgacggcccccaggtggccaacctgcagaatgtggataccggcttctggctggacatgagcaacctgagcgacgtggtgctgtccagagagatccagaccggcctgagagccagagccaccctggaagagtccatgcccatgctggaaaatctggaagagagattccggcggctgcaggaaacctgcgacgccgccagaaccgagatcgaggaaagcggctggacccgggaaagcgcctccagaatggaaggcgacgaagcccagggccccagcagagtgcagcaggcctttcagagcttcgtgaatgagtgcaacagcatcgagttcagcttcggctccttcggcgagcacgtgcgggtgctgtgtgccagagtgtcaagaggactggccgctgccggcgaggccatcagaagatgcttcagctgctgcaagggcagcacccacagatacgcccccagagatgacctgtctcctgagggcgcctctctggccgaaaccctggccagattcgccgacgacatgggcatcgaaagaggcgccgacggcacctacgacatccccctggtggacgattggagaaggggcgtgccatccatcgagggcgagggcagcgatagcatctacgagatcatgatgcccatctacgaagtgatgaacatggacctggaaacccggcggagcttcgccgtgcagcagggccattaccaggaccccagagccagcgactacgacctgcctagagcctccgattacgatctgcccagaagcccctaccccacccctccactgcctcccagataccagctgcagaacatggatgtggaagccggctttcgcgaggccgtgtacgcctcttttgtggccggcatgtacaactacgtcgtgacccagccccaggaacggatccccaatagccagcaggtggaaggcatcctgcgggacatgctgaccaacggcagccagaccttccgggacctgatgaagcggtggaacagagaggtggaccgcgag

SEQ ID NO: 291 - DNA, 1851 bp, Artificial Sequence; identical to SEQ ID NO: 272
  Synthetic Polynucleotide

SEQ ID NO: 292 - DNA, 1323 bp, Artificial Sequence
  Synthetic Polynucleotide
atggaaacccctgcccagctgctgttcctgctgctgctgtggctgcctgacaccaccggcatgacagcatctggcggagctggcggcctgggctctacacagacagtggatgtggccagggcccaggctgctgccgctacacaggatgcccaggaagtgatcggcagccaggaagccagcgaggcctctatgctgaagggctgcgaggacctgatcaaccctgccgccgctacccgcatcaagaagaaagaggaaaagttcgagtccctggaagccagacggaagcccaccgccgacaaggccgagaagaagtccgagagcaccgaggaaaagggcgacacccccctggaagatcggttcaccgaggatctgagcgaggtgtccggcgaggacttccggggcctgaagaacagcttcgacgacgacagcagccccgaggaaatcctggacgccctgaccagcaagttcagcgaccccaccatcaaggacctggccctggactacctgatccagaccgcccccagcgaccggaagctgaagtctgccctgattcaggccaagcaccagctgatgagccagaacccccaggccatcgtgggcggcagaaatgtgctgctggcctccgagacattcgccagcagagccaacaccagccccagctccctgcggagcctgtatctgcaagtgaccagctcccccagcaactgcgacaacctgagacagatgctggctagctacctgccctccgagaaaaccgccgtgatggaattcctcgtgaacggcatggtggccgacctgaaaagcgagggccctagcatccctcccgccaagctgcaggtgtacatgaccgagctgagcaacctgcaggccctgcacagcgtggacagctttttcgaccggaacatcggcaacctggaaaacagcctgaagcacgagggccacgcccccatcccttctctgacaaccggcaatctgaccaagaccttcctgcagctggtggaagataagttccccagcagctccaaggcccagaaggccctgaacgagctcgtgggccctgataccggacctcagaccgaggtgctgaacctgttctttcgggccctgaatggctgctccccccggatcttttctggcgctgagaagaagcagcagctggccagcgtgatcaccaacaccctggatgccatcaacgccgacaacgaggactaccccaagcccggcgacttccccagaagcagctttagcagcaccccccctcatgcccctgtgccccagtctgagatccctaccagcccaaccagcacccagcctccaagccct

SEQ ID NO: 293 - DNA, 1341 bp, Artificial Sequence
  Synthetic Polynucleotide
atggaaacccctgcccagctgctgttcctgctgctgctgtggctgcctgacaccaccggcatgacagcatctggcggagctggcggcctgggctctacacagacagtggatgtggccagggcccaggctgctgccgctacacaggatgcccaggaagtgatcggcagccaggaagccagcgaggcctctatgctgaagggctgcgaggacctgatcaaccctgccgccgctacccgcatcaagaagaaagaggaaaagttcgagtccctggaagccagacggaagcccaccgccgacaaggccgagaagaagtccgagagcaccgaggaaaagggcgacacccccctggaagatcggttcaccgaggatctgagcgaggtgtccggcgaggacttccggggcctgaagaacagcttcgacgacgacagcagccccgaggaaatcctggacgccctgaccagcaagttcagcgaccccaccatcaaggacctggccctggactacctgatccagaccgcccccagcgaccggaagctgaagtctgccctgattcaggccaagcaccagctgatgagccagaacccccaggccatcgtgggcggcagaaatgtgctgctggcctccgagacattcgccagcagagccaacaccagccccagctccctgcggagcctgtatctgcaagtgaccagctcccccagcaactgcgacaacctgagacagatgctggctagctacctgccctccgagaaaaccgccgtgatggaattcctcgtgaacggcatggtggccgacctgaaaagcgagggccctagcatccctcccgccaagctgcaggtgtacatgaccgagctgagcaacctgcaggccctgcacagcgtggacagctttttcgaccggaacatcggcaacctggaaaacagcctgaagcacgagggccacgcccccatcccttctctgacaaccggcaatctgaccaagaccttcctgcagctggtggaagataagttccccagcagctccaaggcccagaaggccctgaacgagctcgtgggccctgataccggacctcagaccgaggtgctgaacctgttctttcgggccctgaatggctgctccccccggatcttttctggcgctgagaagaagcagcagctggccagcgtgatcaccaacaccctggatgccatcaacgccgacaacgaggactaccccaagcccggcgacttccccagaagcagctttagcagcaccccccctcatgcccctgtgccccagtctgagatccctaccagcccaaccagcacccagcctccaagccctcaccaccaccatcaccac

SEQ ID NO: 294 - DNA, 1173 bp, Artificial Sequence
  Synthetic Polynucleotide
atgaaaaaactcttaaaatcggcgtttttatccgccgcattttttgctggtcacgcctccttacacgctttgcctgtagggaacccagcagagccaagtttattaattgatggaacgatatgggaaggtatgtcaggagatccatgtgatccttgcgctacttggtgcgacgcgattagcttacgcgtaggattttacggagattatgttttcgacagagtcctcaagacagatgtgccacagaagttttcaatggggcctatacctacttcaagtacttctcctgaagactcagctatactaacagagagaaataacgcagcgtatggaaaacatatgcacgatgcggagttgttcacaaatgcaggttacattgcgctaaatatttgggaccgtttcgacatcttttgtaccttaggagctactagtgggtattttaaagggaattcttcatctttcaacttgatcggattgattggtatttcaggagcagaccttaacagcaagctcccaaacgcaaatatttctaacggcgtagtagagctatatacagacacaaccttctcttggagcgttggagctcgcggagctttgtgggagtgtggttgcgctactttaggagcagaattccaatacgcacaatcgaaacctcgcgttcaagaattgaatgtcttgtctaacgtagcacaatttactgtacacaaacctcggggatatgtaggccagcctctacctcttccactgactgcaggaacagcaactgattctaatgataaattgaaaaatgccacgatcaactaccatgaatggcaagtcggtgcagcattgtcatatagactgaatatgctcgttccttacatcggtgttcagtggtccagagctacttttgatgcagatactatccaaattgcggaaccaaaattagcttcgccaattttcaacttgacaacatggaatccaacattattaggacaagcaacttcagtagatagcggaaacaagtttgctgactccctacaaattgtttctcttcaaattaacaagttgaagtccagaaaagcttgtggtgtttccatgggagcaactttacttgatgccgataaatgggcaatcaatggggaacttcgtttaattaacgaaagagctgctcacctttctgctcaatgcagattc

SEQ ID NO: 295 - DNA, 92 bp, Artificial Sequence
  Synthetic Polynucleotide
tcaagcttttggaccctcgtacagaagctaatacgactcactatagggaaataagagagaaaagaagagtaagaagaaatataagagccacc

SEQ ID NO: 296 - DNA, 47 bp, Artificial Sequence
  Synthetic Polynucleotide
gggaaataagagagaaaagaagagtaagaagaaatataagagccacc

SEQ ID NO: 297 - DNA, 119 bp, Artificial Sequence
  Synthetic Polynucleotide
tgataataggctggagcctcggtggccatgcttcttgccccttgggcctccccccagcccctcctccccttcctgcacccgtacccccgtggtctttgaataaagtctgagtgggcggc

SEQ ID NO: 298 - DNA, 1729 bp, Artificial Sequence
  Synthetic Polynucleotide
tcaagcttttggaccctcgtacagaagctaatacgactcactatagggaaataagagagaaaagaagagtaagaagaaatataagagccaccatggcacaagtcattaatacaaacagcctgtcgctgttgacccagaataacctgaacaaatcccagtccgcactgggcactgctatcgagcgtttgtcttccggtctgcgtatcaacagcgcgaaagacgatgcggcaggacaggcgattgctaaccgttttaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgcgaatggtactaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggtgccaacgacggtgaaactatcgatattgatttaaaagaaatcagctctaaaacactgggacttgataagcttaatgtccaagatgcctacaccccgaaagaaactgctgtaaccgttgataaaactacctataaaaatggtacagatcctattacagcccagagcaatactgatatccaaactgcaattggcggtggtgcaacgggggttactggggctgatatcaaatttaaagatggtcaatactatttagatgttaaaggcggtgcttctgctggtgtttataaagccacttatgatgaaactacaaagaaagttaatattgatacgactgataaaactccgttggcaactgcggaagctacagctattcggggaacggccactataacccacaaccaaattgctgaagtaacaaaagagggtgttgatacgaccacagttgcggctcaacttgctgcagcaggggttactggcgccgataaggacaatactagccttgtaaaactatcgtttgaggataaaaacggtaaggttattgatggtggctatgcagtgaaaatgggcgacgatttctatgccgctacatatgatgagaaaacaggtgcaattactgctaaaaccactacttatacagatggtactggcgttgctcaaactggagctgtgaaatttggtggcgcaaatggtaaatctgaagttgttactgctaccgatggtaagacttacttagcaagcgaccttgacaaacataacttcagaacaggcggtgagcttaaagaggttaatacagataagactgaaaacccactgcagaaaattgatgctgccttggcacaggttgatacacttcgttctgacctgggtgcggttcagaaccgtttcaactccgctatcaccaacctgggcaataccgtaaataacctgtcttctgcccgtagccgtatcgaagattccgactacgcaaccgaagtctccaacatgtctcgcgcgcagattctgcagcaggccggtacctccgttctggcgcaggcgaaccaggttccgcaaaacgtcctctctttactgcgttgataataggctggagcctcggtggccatgcttcttgccccttgggcctccccccagcccctcctccccttcctgcacccgtacccccgtggtctttgaataaagtctgagtgggcggc

SEQ ID NO: 299 - DNA, 1518 bp, Artificial Sequence
  Synthetic Polynucleotide
atggcacaagtcattaatacaaacagcctgtcgctgttgacccagaataacctgaacaaatcccagtccgcactgggcactgctatcgagcgtttgtcttccggtctgcgtatcaacagcgcgaaagacgatgcggcaggacaggcgattgctaaccgttttaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgcgaatggtactaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggtgccaacgacggtgaaactatcgatattgatttaaaagaaatcagctctaaaacactgggacttgataagcttaatgtccaagatgcctacaccccgaaagaaactgctgtaaccgttgataaaactacctataaaaatggtacagatcctattacagcccagagcaatactgatatccaaactgcaattggcggtggtgcaacgggggttactggggctgatatcaaatttaaagatggtcaatactatttagatgttaaaggcggtgcttctgctggtgtttataaagccacttatgatgaaactacaaagaaagttaatattgatacgactgataaaactccgttggcaactgcggaagctacagctattcggggaacggccactataacccacaaccaaattgctgaagtaacaaaagagggtgttgatacgaccacagttgcggctcaacttgctgcagcaggggttactggcgccgataaggacaatactagccttgtaaaactatcgtttgaggataaaaacggtaaggttattgatggtggctatgcagtgaaaatgggcgacgatttctatgccgctacatatgatgagaaaacaggtgcaattactgctaaaaccactacttatacagatggtactggcgttgctcaaactggagctgtgaaatttggtggcgcaaatggtaaatctgaagttgttactgctaccgatggtaagacttacttagcaagcgaccttgacaaacataacttcagaacaggcggtgagcttaaagaggttaatacagataagactgaaaacccactgcagaaaattgatgctgccttggcacaggttgatacacttcgttctgacctgggtgcggttcagaaccgtttcaactccgctatcaccaacctgggcaataccgtaaataacctgtcttctgcccgtagccgtatcgaagattccgactacgcaaccgaagtctccaacatgtctcgcgcgcagattctgcagcaggccggtacctccgttctggcgcaggcgaaccaggttccgcaaaacgtcctctctttactgcgt

SEQ ID NO: 300 - RNA, 1790 nt, Artificial Sequence
  Synthetic Polynucleotide
ggggaaauaagagagaaaagaagaguaagaagaaauauaagagccaccauggcacaagucauuaauacaaacagccugucgcuguugacccagaauaaccugaacaaaucccaguccgcacugggcacugcuaucgagcguuugucuuccggucugcguaucaacagcgcgaaagacgaugcggcaggacaggcgauugcuaaccguuuuaccgcgaacaucaaaggucugacucaggcuucccguaacgcuaacgacgguaucuccauugcgcagaccacugaaggcgcgcugaacgaaaucaacaacaaccugcagcgugugcgugaacuggcgguucagucugcgaaugguacuaacucccagucugaccucgacuccauccaggcugaaaucacccagcgccugaacgaaaucgaccguguauccggccagacucaguucaacggcgugaaaguccuggcgcaggacaacacccugaccauccagguuggugccaacgacggugaaacuaucgauauugauuuaaaagaaaucagcucuaaaacacugggacuugauaagcuuaauguccaagaugccuacaccccgaaagaaacugcuguaaccguugauaaaacuaccuauaaaaaugguacagauccuauuacagcccagagcaauacugauauccaaacugcaauuggcgguggugcaacggggguuacuggggcugauaucaaauuuaaagauggucaauacuauuuagauguuaaaggcggugcuucugcugguguuuauaaagccacuuaugaugaaacuacaaagaaaguuaauauugauacgacugauaaaacuccguuggcaacugcggaagcuacagcuauucggggaacggccacuauaacccacaaccaaauugcugaaguaacaaaagaggguguugauacgaccacaguugcggcucaacuugcugcagcagggguuacuggcgccgauaaggacaauacuagccuuguaaaacuaucguuugaggauaaaaacgguaagguuauugaugguggcuaugcagugaaaaugggcgacgauuucuaugccgcuacauaugaugagaaaacaggugcaauuacugcuaaaaccacuacuuauacagaugguacuggcguugcucaaacuggagcugugaaauuugguggcgcaaaugguaaaucugaaguuguuacugcuaccgaugguaagacuuacuuagcaagcgaccuugacaaacauaacuucagaacaggcggugagcuuaaagagguuaauacagauaagacugaaaacccacugcagaaaauugaugcugccuuggcacagguugauacacuucguucugaccugggugcgguucagaaccguuucaacuccgcuaucaccaaccugggcaauaccguaaauaaccugucuucugcccguagccguaucgaagauuccgacuacgcaaccgaagucuccaacaugucucgcgcgcagauucugcagcaggccgguaccuccguucuggcgcaggcgaaccagguuccgcaaaacguccucucuuuacugcguugauaauaggcuggagccucgguggccaugcuucuugccccuugggccuccccccagccccuccuccccuuccugcacccguacccccguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 301 - protein, 506 aa, Artificial Sequence
  Synthetic Polypeptide
MAQVINTNSLSLLTQNNLNKSQSALGTAIERLSSGLRINSAKDDAAGQAIANRFTANIKGLTQASRNANDGISIAQTTEGALNEINNNLQRVRELAVQSANGTNSQSDLDSIQAEITQRLNEIDRVSGQTQFNGVKVLAQDNTLTIQVGANDGETIDIDLKEISSKTLGLDKLNVQDAYTPKETAVTVDKTTYKNGTDPITAQSNTDIQTAIGGGATGVTGADIKFKDGQYYLDVKGGASAGVYKATYDETTKKVNIDTTDKTPLATAEATAIRGTATITHNQIAEVTKEGVDTTTVAAQLAAAGVTGADKDNTSLVKLSFEDKNGKVIDGGYAVKMGDDFYAATYDEKTGAITAKTTTYTDGTGVAQTGAVKFGGANGKSEVVTATDGKTYLASDLDKHNFRTGGELKEVNTDKTENPLQKIDAALAQVDTLRSDLGAVQNRFNSAITNLGNTVNNLSSARSRIEDSDYATEVSNMSRAQILQQAGTSVLAQANQVPQNVLSLLR

SEQ ID NO: 302 - protein, 698 aa, Artificial Sequence
  Synthetic Polypeptide
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDTLNVQQKYKVSDTAATVTGYADTTIALDNSTFKASATGLGGTDQKIDGDLKFDDTTGKYYAKVTVTGGTGKDGYYEVSVDKTNGEVTLAGGATSPLTGGLPATATEDVKNVQVANADLTEAKAALTAAGVTGTASVVKMSYTDNNGKTIDGGLAVKVGDDYYSATQNKDGSISINTTKYTADDGTSKTALNKLGGADGKTEVVSIGGKTYAASKAEGHNFKAQPDLAEAAATTTENPLQKIDAALAQVDTLRSDLGAVQNRFNSAITNLGNTVNNLTSARSRIEDSDYATEVSNMSRAQILQQAGTSVLAQANQVPQNVLSLLRGGGGSGGGGSMMAPDPNANPNANPNANPNANPNANPNANPNANPNANPNANPNANPNANPNANPNANPNANPNANPNANPNANPNANPNANPNKNNQGNGQGHNMPNDPNRNVDENANANNAVKNNNNEEPSDKHIEQYLKKIKNSISTEWSPCSVTCGNGIQVRIKPGSANKPKDELDYENDIEKKICKMEKCSSVFNVVNS

SEQ ID NO: 303 - protein, 692 aa, Artificial Sequence
  Synthetic Polypeptide
MMAPDPNANPNANPNANPNANPNANPNANPNANPNANPNANPNANPNANPNANPNANPNANPNANPNANPNANPNANPNANPNKNNQGNGQGHNMPNDPNRNVDENANANNAVKNNNNEEPSDKHIEQYLKKIKNSISTEWSPCSVTCGNGIQVRIKPGSANKPKDELDYENDIEKKICKMEKCSSVFNVVNSRPVTMAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDTLNVQQKYKVSDTAATVTGYADTTIALDNSTFKASATGLGGTDQKIDGDLKFDDTTGKYYAKVTVTGGTGKDGYYEVSVDKTNGEVTLAGGATSPLTGGLPATATEDVKNVQVANADLTEAKAALTAAGVTGTASVVKMSYTDNNGKTIDGGLAVKVGDDYYSATQNKDGSISINTTKYTADDGTSKTALNKLGGADGKTEVVSIGGKTYAASKAEGHNFKAQPDLAEAAATTTENPLQKIDAALAQVDTLRSDLGAVQNRFNSAITNLGNTVNNLTSARSRIEDSDYATEVSNMSRAQILQQAGTSVLAQANQVPQNVLSLLR

SEQ ID NO: 304 - protein, 20 aa, Artificial Sequence
  Synthetic Polypeptide
METPAQLLFLLLLWLPDTTG

SEQ ID NO: 305 - protein, 18 aa, Artificial Sequence
  Synthetic Polypeptide
MDWTWILFLVAAATRVHS

SEQ ID NO: 306 - protein, 24 aa, Artificial Sequence
  Synthetic Polypeptide
MLGSNSGQRVVFTILLLLVAPAYS

SEQ ID NO: 307 - protein, 17 aa, Artificial Sequence
  Synthetic Polypeptide
MKCLLYLAFLFIGVNCA

SEQ ID NO: 308 - protein, 15 aa, Artificial Sequence
  Synthetic Polypeptide
MWLVSLAIVTACAGA

SEQ ID NO: 309 - protein, 22 aa, Chlamydia trachomatis
MKKLLKSVLAFAVLGSASSLHA

SEQ ID NO: 310 - protein, 22 aa, Chlamydia trachomatis
MKKLLKSVLVFAALGSASSLQA

SEQ ID NO: 311 - protein, 20 aa, Shigella flexneri
MKSKFLVLALCVPAIFTTHA

SEQ ID NO: 312 - protein, 20 aa, Salmonella enterica
MKTHVIAVMIIAVFSESVYA

SEQ ID NO: 313 - protein, 20 aa, Yersinia pestis
MKKSSIVATIITILSGSANA

SEQ ID NO: 314 - protein, 23 aa, Escherichia coli
MQTKLLAIMLAAPVVFSSQEASA

SEQ ID NO: 315 - protein, 21 aa, Escherichia coli
MKKTAIAIAVALAGFATVAQA

SEQ ID NO: 316 - protein, 22 aa, Erwinia carotovora
MKYLLPTAAAGLLLLAAQPAMA

SEQ ID NO: 317 - RNA, 1194 nt, Chlamydia trachomatis
augaaaaaacucuugaaaucgguauuaguauuugccgcuuugaguucugcuuccuccuugcaagcucugccuguggggaauccugcugaaccaagccuuaugaucgacggaauucugugggaagguuuuggcggagauccuugcgauccuugcaccacuuggugugacgcuaucagcaugcguguugguuacuacggagacuuuguuuucgaccguguuuugaaaacugaugugaauaaagaauuucagaugggagcggcgccuacuaccagcgauguaguaggcuuacaaaacgauccaacaacaaacguugcucguccaaaucccgcuuauggcaaacacaugcaagaugcugaaauguuuacgaacgcugcuuacauggcauuaaauaucugggaucguuuugauguauuuuguacauugggagcaacuaccgguuauuuaaaaggaaacucugcuuccuucaacuuaguuggauuauucggaacaaaaacacaaucuucuagcuuuaauacagcgaagcuuauuccuaacacugcuuugaaugaagcugugguugagcuuuauauaaacacuaccuuugcuuggagcguaggugcucgugcagcucucugggaaugugggugugcaacguuaggagcuucuuuccaauaugcucaaucuaaaccuaaaguagaagaguuaaauguucuuuguaaugcauccgaauuuacuauuaauaagccgaaaggauauguuggggcggaauuuccacuuaauauuaccgcaggaacagaagcugcgacagggacuaaggaugccucuauugacuaccaugaguggcaagcaaguuuagcccuuucuuacagauuaaauauguucacuccuuacauuggaguuaaauggucuagaguaaguuuugaugccgacacgauccguaucgcucagccuaaauuggcugaagcaaucuuggaugucacuacucuaaacccgaccaucgcugguaaaggaaguguggucucugccggaaccgauaacgaacuggcugauacaaugcaaaucguuuccuugcaguugaacaagaugaaaucuagaaaaucuugcgguauugcaguaggaacgacuauuguagaugcagacaaauacgcaguuacaguugaggcucgcuugaucgaugagagagcagcucacguaaaugcacaauuccgguucuaa

SEQ ID NO: 318 - RNA, 1194 nt, Chlamydia trachomatis
augaaaaaacucuugaaaucgguauuaguauuugccgcuuugaguucugcuuccuccuugcaagcucugccuguggggaauccugcugaaccaagccuuaugaucgacggaauucugugggaagguuuuggcggagauccuugcgauccuugcaccacuuggugugacgcuaucagcaugcguguugguuacuacggagacuuuguuuucgaccguguuuugaaaacugaugugaauaaagaauuucagaugggagcggcgccuacuaccagcgauguagcaggcuuacaaaacgauccaacaacaaacguugcucguccaaaucccgcuuauggcaaacacaugcaagaugcugaaauguuuacgaacgcugcuuacauggcauuaaauaucugggaucguuuugauguauuuuguacauugggagcaacuaccgguuauuuaaaaggaaacucugcuuccuucaacuuaguuggauuauucggaacaaaaacacaaucuucuagcuuuaauacagcgaagcuuauuccuaacacugcuuugaaugaagcugugguugagcuuuauauaaacacuaccuuugcuuggagcguaggugcucgugcagcucucugggaaugugggugugcaacguuaggagcuucuuuccaauaugcucaaucuaaaccuaaaguagaagaguuaaauguucuuuguaaugcauccgaauuuacuauuaauaagccgaaaggauauguuggggcggaauuuccacuuaauauuaccgcaggaacagaagcugcgacagggacuaaggaugccucuauugacuaccaugaguggcaagcaaguuuagcccuuucuuacagauuaaauauguucacuccuuacauuggaguuaaauggucuagaguaaguuuugaugccgacacgauccguaucgcucagccuaaauuggcugaagcaaucuuggaugucacuacucuaaacccgaccaucgcugguaaaggaaguguggucucuuccggaaccgauaacgaacuggcugauacaaugcaaaucguuuccuugcaguugaacaagaugaaaucuagaaaaucuugcgguauugcaguaggaacgacuauuguagaugcagacaaauacgcaguuacaguugaggcucgcuugaucgaugagagagcagcucacguaaaugcacaauuccgguucuaa

SEQ ID NO: 319 - RNA, 1194 nt, Chlamydia trachomatis
augaaaaaacucuugaaaucgguauuaguauuugccgcuuugaguucugcuuccuccuugcaagcucugccuguggggaauccugcugaaccaagccuuaugaucgacggaauucugugggaagguuuuggcggagauccuugcgauccuugcaccacuuggugugacgcuaucagcaugcguguugguuacuacggagacuuuguuuucgaccguguuuugaaaacugaugugaauaaagaauuucagaugggagcggcgccuacuaccagcgauguaguaggcuuacaaaacgauccaacaacaaacguugcucguccaaaucccgcuuauggcaaacacaugcaagaugcugaaauguuuacgaacgcugcuuacauggcauuaaauaucugggaucguuuugauguauuuuguacauugggagcaacuaccgguuauuuaaaaggaaacucugcuuccuucaacuuaguuggauuauucggaacaaaaacacaaucuucuagcuuuaauacagcgaagcuuauuccuaacacugcuuugaaugaagcugugguugagcuuuauauaaacacuaccuuugcuuggagcguaggugcucgugcagcucucugggaaugugggugugcaacguuaggagcuucuuuccaauaugcucaaucuaaaccuaaaguagaagaguuaaauguucuuuguaaugcauccgaauuuacuauuaauaagccgaaaggauauguuggggcggaauuuccacuuaauauuaccgcaggaacagaagcugcgacagggacuaaggaugccucuauugacuaccaugaguggcaagcaaguuuagcccuuucuuacagauuaaauauguucacuccuuacauuggaguuaaauggucuagaguaaguuuugaugccgacacgauccguaucgcucagccuaaauuggcugaagcaaucuuggaugucacuacucuaaacccgaccaucgcugguaaaggaaguguggucucuuccggaaccgauaacgaacuggcugauacaaugcaaaucguuuccuugcaguugaacaagaugaaaucuagaaaaucuugcgguauugcaguaggaacgacuauuguagaugcagacaaauacgcaguuacaguugaggcucgcuugaucgaugagagagcagcucacguaaaugcacaauuccgguucuaa

SEQ ID NO: 320 - RNA, 399 nt, Artificial Sequence
  Synthetic Polynucleotide
auggaaaccccugcccagcugcuguuccugcugcugcuguggcugccugauaccaccggcccuccccugcccagcagcacacaggacaacagauccauggaccagcaggacagcgaagaguuccugcugcagaacacccuggaagauagcgagaucaucagcauccccgacaccaugaaccagaucgccaucgacaccgagaagugguucuaccugaacaaggacugcaccaacgugggccccaucuccaucgugcagcugacagccuuccugaaagagugcaagcacagccccgagaagggcaucgacccccaggaacuguggguguggaagaaaggcaugcccaacugggagaaagugaagaacauccccgagcugagcggcaccgugaaggacgag

SEQ ID NO: 321 - RNA, 417 nt, Artificial Sequence
  Synthetic Polynucleotide
auggaaaccccugcccagcugcuguuccugcugcugcuguggcugccugauaccaccggcccuccccugcccagcagcacacaggacaacagauccauggaccagcaggacagcgaagaguuccugcugcagaacacccuggaagauagcgagaucaucagcauccccgacaccaugaaccagaucgccaucgacaccgagaagugguucuaccugaacaaggacugcaccaacgugggccccaucuccaucgugcagcugacagccuuccugaaagagugcaagcacagccccgagaagggcaucgacccccaggaacuguggguguggaagaaaggcaugcccaacugggagaaagugaagaacauccccgagcugagcggcaccgugaaggacgagcaccaccaccaucaccac

SEQ ID NO: 322 - RNA, 3183 nt, Artificial Sequence
  Synthetic Polynucleotide
auggaaaccccugcucagcugcuguuccugcugcugcuguggcugccugauacaaccggcgagccuaagagcugcgacaagacccacaccuguccuccauguccugcuccagaacugcucggcggaccuuccguguuccuguuuccuccaaagccuaaggacacccugaugaucagcagaaccccugaagugaccugcguggugguggaugugucccacgaggaucccgaagugaaguucaauugguacguggacggcguggaagugcacaacgccaagaccaagccuagagaggaacaguacaacagcaccuacagagugguguccgugcugaccgugcugcaccaggauuggcugaacggcaaagaguacaagugcaagguguccaacaaggcccugccugcuccuaucgagaagaccaucagcaaggccaagggccagccaagagaaccccagguguacacacugccuccaagcagagaugagcugaccaagaaccaggugucccugaccugucuggucaagggcuucuaccccuccgauaucgccguggaaugggagagcaauggccagccugagaacaacuacaagacaaccccuccugugcuggacagcgacggcucauucuuccuguacagcaagcugacaguggacaagagcagauggcagcagggcaacguguucagcugcagcgugaugcacgaggcccugcacaaucacuacacccagaagucccugucucugagccccggcaagaugagcaucagaggcgugggcggcaacggcaacagcagaaucccuagccacaacggcgacggcagcaacaggcggagccagaacaccaagggcaacaacaagguggaagauagagugugcagccuguacagcagccgguccaacgagaaccgcgagagcccuuaugccgugguggacguguccagcaugaucgagagcacccccaccagcggcgagacaaccagagcuaguagaggcgugcugagccgguuccagaggggccucgugcggauugcugacaaagugcggagagccgugcagugcgcuuggagcagcguguccacaagcagaagcagcgccacaagagccgccgagagcggcagcucuagcagaacagcuagaggcgccagcagcggcuacagagaguacagcccuucugccgcucggggccugcggcugauguucaccgacuuuuggcggacccgggugcugagacagaccucuccuauggccggcguguucggcaaccuggacgugaacgaggccagacugauggccgccuacaccagcgagugugccgaucaccuggaagccaaagagcuggccggaccugacggcguggcagccgcuagagaaaucgccaagagaugggagaagagagugcgggaccugcaggacaagggcgcugccagaaagcugcugaacgacccccugggcagacggacccccaacuaccagagcaagaaccccggcgaguacaccgugggcaacuccauguucuacgacggcccccagguggccaaccugcagaauguggauaccggcuucuggcuggacaugcagcaccugagcgacguggugcuguccagagagauccagaccggccugagagccagagccacccuggaagaguccaugcccaugcuggaaaaucuggaagagagauuccggcggcugcaggaaaccugcgacgccgccagaaccgagaucgaggaaagcggcuggacccgggaaagcgccuccagaauggaaggcgacgaagcccagggccccagcagagugcagcaggccuuucagagcuucgugaaugagugcaacagcaucgaguucagcuucggcuccuucggcgagcacgugcgggugcugugugccagagugucaagaggacuggccgcugccggcgaggccaucagaagaugcuucagcugcugcaagggcagcacccacagauacgcccccagagaugaccugucuccugagggcgccucucuggccgaaacccuggccagauucgccgacgacaugggcaucgaaagaggcgccgacggcaccuacgacaucccccugguggacgauuggagaaggggcgugccauccaucgagggcgagggcagcgauagcaucuacgagaucaugaugcccaucuacgaagugaugaacauggaccuggaaacccggcggagcuucgccgugcagcagggccauuaccaggaccccagagccagcgacuacgaccugccuagagccuccgauuacgaucugcccagaagccccuaccccaccccuccacugccucccagauaccagcugcagaacauggauguggaagccggcuuucgcgaggccguguacgccucuuuuguggccggcauguacaacuacgucgugacccagccccaggaacggauccccaauagccagcagguggaaggcauccugcgggacaugcugaccaacggcgaccagaccuuccgggaccugaugaagcgguggaacagagagguggaccgcgagaugagcccuauccucggcuacuggaagaucaaaggccuggugcagcccaccagacugcugcuggaauaccuggaagagaaguacgaggaacaccuguacgagcgcgacgagggcgauaaguggcggaacaagaaguucgagcugggccucgaguuccccaaccugccuuacuacaucgacggcgacgugaagcugacccagagcauggccaucauccgguauaucgccgacaagcacaacaugcucggcggcugcccuaaagagcgggccgagauuucuaugcuggaaggcgccgugcuggacaucagauacggcguguccagaaucgccuacagcaaggacuucgaaacccugaagguggacuuccugagcaagcugcccgagaugcugaagauguucgaggaccggcugugccacaagaccuaccugaauggcgaccacgugacacaccccgacuucaugcuguacgacgcccuggauguggugcuguacauggaccccaugugccuggacgccuuuccaaagcucgugugcuucaagaagcggaucgaggccauuccucagaucgacaaguaccugaaguccagcaaguauaucgcuuggccccugcaaggcuggcaggccacauuuggaggcggagaucacccuccuaag

SEQ ID NO: 323 - RNA, 2547 nt, Artificial Sequence
  Synthetic Polynucleotide
auggaaaccccugcucagcugcuguuccugcugcugcuguggcugccugauacaaccggcgagccuaagagcugcgacaagacccacaccuguccuccauguccugcuccagaacugcucggcggaccuuccguguuccuguuuccuccaaagccuaaggacacccugaugaucagcagaaccccugaagugaccugcguggugguggaugugucccacgaggaucccgaagugaaguucaauugguacguggacggcguggaagugcacaacgccaagaccaagccuagagaggaacaguacaacagcaccuacagagugguguccgugcugaccgugcugcaccaggauuggcugaacggcaaagaguacaagugcaagguguccaacaaggcccugccugcuccuaucgagaagaccaucagcaaggccaagggccagccaagagaaccccagguguacacacugccuccaagcagagaugagcugaccaagaaccaggugucccugaccugucuggucaagggcuucuaccccuccgauaucgccguggaaugggagagcaauggccagccugagaacaacuacaagacaaccccuccugugcuggacagcgacggcucauucuuccuguacagcaagcugacaguggacaagagcagauggcagcagggcaacguguucagcugcagcgugaugcacgaggcccugcacaaucacuacacccagaagucccugucucugagccccggcaagaugagcaucagaggcgugggcggcaacggcaacagcagaaucccuagccacaacggcgacggcagcaacaggcggagccagaacaccaagggcaacaacaagguggaagauagagugugcagccuguacagcagccgguccaacgagaaccgcgagagcccuuaugccgugguggacguguccagcaugaucgagagcacccccaccagcggcgagacaaccagagcuaguagaggcgugcugagccgguuccagaggggccucgugcggauugcugacaaagugcggagagccgugcagugcgcuuggagcagcguguccacaagcagaagcagcgccacaagagccgccgagagcggcagcucuagcagaacagcuagaggcgccagcagcggcuacagagaguacagcccuucugccgcucggggccugcggcugauguucaccgacuuuuggcggacccgggugcugagacagaccucuccuauggccggcguguucggcaaccuggacgugaacgaggccagacugauggccgccuacaccagcgagugugccgaucaccuggaagccaaagagcuggccggaccugacggcguggcagccgcuagagaaaucgccaagagaugggagaagagagugcgggaccugcaggacaagggcgcugccagaaagcugcugaacgacccccugggcagacggacccccaacuaccagagcaagaaccccggcgaguacaccgugggcaacuccauguucuacgacggcccccagguggccaaccugcagaauguggauaccggcuucuggcuggacaugagcaaccugagcgacguggugcuguccagagagauccagaccggccugagagccagagccacccuggaagaguccaugcccaugcuggaaaaucuggaagagagauuccggcggcugcaggaaaccugcgacgccgccagaaccgagaucgaggaaagcggcuggacccgggaaagcgccuccagaauggaaggcgacgaagcccagggccccagcagagugcagcaggccuuucagagcuucgugaaugagugcaacagcaucgaguucagcuucggcuccuucggcgagcacgugcgggugcugugugccagagugucaagaggacuggccgcugccggcgaggccaucagaagaugcuucagcugcugcaagggcagcacccacagauacgcccccagagaugaccugucuccugagggcgccucucuggccgaaacccuggccagauucgccgacgacaugggcaucgaaagaggcgccgacggcaccuacgacaucccccugguggacgauuggagaaggggcgugccauccaucgagggcgagggcagcgauagcaucuacgagaucaugaugcccaucuacgaagugaugaacauggaccuggaaacccggcggagcuucgccgugcagcagggccauuaccaggaccccagagccagcgacuacgaccugccuagagccuccgauuacgaucugcccagaagccccuaccccaccccuccacugccucccagauaccagcugcagaacauggauguggaagccggcuuucgcgaggccguguacgccucuuuuguggccggcauguacaacuacgucgugacccagccccaggaacggauccccaauagccagcagguggaaggcauccugcgggacaugcugaccaacggcagccagaccuuccgggaccugaugaagcgguggaacagagagguggaccgcgagcaccaccaucaccaccac

SEQ ID NO: 324 - RNA, 2529 nt, Artificial Sequence
  Synthetic Polynucleotide
auggaaaccccugcucagcugcuguuccugcugcugcuguggcugccugauacaaccggcgagccuaagagcugcgacaagacccacaccuguccuccauguccugcuccagaacugcucggcggaccuuccguguuccuguuuccuccaaagccuaaggacacccugaugaucagcagaaccccugaagugaccugcguggugguggaugugucccacgaggaucccgaagugaaguucaauugguacguggacggcguggaagugcacaacgccaagaccaagccuagagaggaacaguacaacagcaccuacagagugguguccgugcugaccgugcugcaccaggauuggcugaacggcaaagaguacaagugcaagguguccaacaaggcccugccugcuccuaucgagaagaccaucagcaaggccaagggccagccaagagaaccccagguguacacacugccuccaagcagagaugagcugaccaagaaccaggugucccugaccugucuggucaagggcuucuaccccuccgauaucgccguggaaugggagagcaauggccagccugagaacaacuacaagacaaccccuccugugcuggacagcgacggcucauucuuccuguacagcaagcugacaguggacaagagcagauggcagcagggcaacguguucagcugcagcgugaugcacgaggcccugcacaaucacuacacccagaagucccugucucugagccccggcaagaugagcaucagaggcgugggcggcaacggcaacagcagaaucccuagccacaacggcgacggcagcaacaggcggagccagaacaccaagggcaacaacaagguggaagauagagugugcagccuguacagcagccgguccaacgagaaccgcgagagcccuuaugccgugguggacguguccagcaugaucgagagcacccccaccagcggcgagacaaccagagcuaguagaggcgugcugagccgguuccagaggggccucgugcggauugcugacaaagugcggagagccgugcagugcgcuuggagcagcguguccacaagcagaagcagcgccacaagagccgccgagagcggcagcucuagcagaacagcuagaggcgccagcagcggcuacagagaguacagcccuucugccgcucggggccugcggcugauguucaccgacuuuuggcggacccgggugcugagacagaccucuccuauggccggcguguucggcaaccuggacgugaacgaggccagacugauggccgccuacaccagcgagugugccgaucaccuggaagccaaagagcuggccggaccugacggcguggcagccgcuagagaaaucgccaagagaugggagaagagagugcgggaccugcaggacaagggcgcugccagaaagcugcugaacgacccccugggcagacggacccccaacuaccagagcaagaaccccggcgaguacaccgugggcaacuccauguucuacgacggcccccagguggccaaccugcagaauguggauaccggcuucuggcuggacaugcagcaccugagcgacguggugcuguccagagagauccagaccggccugagagccagagccacccuggaagaguccaugcccaugcuggaaaaucuggaagagagauuccggcggcugcaggaaaccugcgacgccgccagaaccgagaucgaggaaagcggcuggacccgggaaagcgccuccagaauggaaggcgacgaagcccagggccccagcagagugcagcaggccuuucagagcuucgugaaugagugcaacagcaucgaguucagcuucggcuccuucggcgagcacgugcgggugcugugugccagagugucaagaggacuggccgcugccggcgaggccaucagaagaugcuucagcugcugcaagggcagcacccacagauacgcccccagagaugaccugucuccugagggcgccucucuggccgaaacccuggccagauucgccgacgacaugggcaucgaaagaggcgccgacggcaccuacgacaucccccugguggacgauuggagaaggggcgugccauccaucgagggcgagggcagcgauagcaucuacgagaucaugaugcccaucuacgaagugaugaacauggaccuggaaacccggcggagcuucgccgugcagcagggccauuaccaggaccccagagccagcgacuacgaccugccuagagccuccgauuacgaucugcccagaagccccuaccccaccccuccacugccucccagauaccagcugcagaacauggauguggaagccggcuuucgcgaggccguguacgccucuuuuguggccggcauguacaacuacgucgugacccagccccaggaacggauccccaauagccagcagguggaaggcauccugcgggacaugcugaccaacggcgaccagaccuuccgggaccugaugaagcgguggaacagagagguggaccgcgag

SEQ ID NO: 325 - RNA, 2529 nt, Artificial Sequence
  Synthetic Polynucleotide
auggaaaccccugcucagcugcuguuccugcugcugcuguggcugccugauacaaccggcgagccuaagagcugcgacaagacccacaccuguccuccauguccugcuccagaacugcucggcggaccuuccguguuccuguuuccuccaaagccuaaggacacccugaugaucagcagaaccccugaagugaccugcguggugguggaugugucccacgaggaucccgaagugaaguucaauugguacguggacggcguggaagugcacaacgccaagaccaagccuagagaggaacaguacaacagcaccuacagagugguguccgugcugaccgugcugcaccaggauuggcugaacggcaaagaguacaagugcaagguguccaacaaggcccugccugcuccuaucgagaagaccaucagcaaggccaagggccagccaagagaaccccagguguacacacugccuccaagcagagaugagcugaccaagaaccaggugucccugaccugucuggucaagggcuucuaccccuccgauaucgccguggaaugggagagcaauggccagccugagaacaacuacaagacaaccccuccugugcuggacagcgacggcucauucuuccuguacagcaagcugacaguggacaagagcagauggcagcagggcaacguguucagcugcagcgugaugcacgaggcccugcacaaucacuacacccagaagucccugucucugagccccggcaagaugagcaucagaggcgugggcggcaacggcaacagcagaaucccuagccacaacggcgacggcagcaacaggcggagccagaacaccaagggcaacaacaagguggaagauagagugugcagccuguacagcagccgguccaacgagaaccgcgagagcccuuaugccgugguggacguguccagcaugaucgagagcacccccaccagcggcgagacaaccagagcuaguagaggcgugcugagccgguuccagaggggccucgugcggauugcugacaaagugcggagagccgugcagugcgcuuggagcagcguguccacaagcagaagcagcgccacaagagccgccgagagcggcagcucuagcagaacagcuagaggcgccagcagcggcuacagagaguacagcccuucugccgcucggggccugcggcugauguucaccgacuuuuggcggacccgggugcugagacagaccucuccuauggccggcguguucggcaaccuggacgugaacgaggccagacugauggccgccuacaccagcgagugugccgaucaccuggaagccaaagagcuggccggaccugacggcguggcagccgcuagagaaaucgccaagagaugggagaagagagugcgggaccugcaggacaagggcgcugccagaaagcugcugaacgacccccugggcagacggacccccaacuaccagagcaagaaccccggcgaguacaccgugggcaacuccauguucuacgacggcccccagguggccaaccugcagaauguggauaccggcuucuggcuggacaugagcaaccugagcgacguggugcuguccagagagauccagaccggccugagagccagagccacccuggaagaguccaugcccaugcuggaaaaucuggaagagagauuccggcggcugcaggaaaccugcgacgccgccagaaccgagaucgaggaaagcggcuggacccgggaaagcgccuccagaauggaaggcgacgaagcccagggccccagcagagugcagcaggccuuucagagcuucgugaaugagugcaacagcaucgaguucagcuucggcuccuucggcgagcacgugcgggugcugugugccagagugucaagaggacuggccgcugccggcgaggccaucagaagaugcuucagcugcugcaagggcagcacccacagauacgcccccagagaugaccugucuccugagggcgccucucuggccgaaacccuggccagauucgccgacgacaugggcaucgaaagaggcgccgacggcaccuacgacaucccccugguggacgauuggagaaggggcgugccauccaucgagggcgagggcagcgauagcaucuacgagaucaugaugcccaucuacgaagugaugaacauggaccuggaaacccggcggagcuucgccgugcagcagggccauuaccaggaccccagagccagcgacuacgaccugccuagagccuccgauuacgaucugcccagaagccccuaccccaccccuccacugccucccagauaccagcugcagaacauggauguggaagccggcuuucgcgaggccguguacgccucuuuuguggccggcauguacaacuacgucgugacccagccccaggaacggauccccaauagccagcagguggaaggcauccugcgggacaugcugaccaacggcagccagaccuuccgggaccugaugaagcgguggaacagagagguggaccgcgag

SEQ ID NO: 326 - RNA, 2505 nt, Artificial Sequence
  Synthetic Polynucleotide
auggaaaccccugcccagcugcuguuccugcugcugcuguggcugccugacaccaccggcaugagcccuauccucggcuacuggaagaucaaaggccuggugcagcccaccagacugcugcuggaauaccuggaagagaaguacgaggaacaccuguacgagcgcgacgagggcgauaaguggcggaacaagaaguucgagcugggccucgaguuccccaaccugccuuacuacaucgacggcgacgugaagcugacccagagcauggccaucauccgguauaucgccgacaagcacaacaugcucggcggcugcccuaaagagcgggccgagauuucuaugcuggaaggcgccgugcuggacaucagauacggcguguccagaaucgccuacagcaaggacuucgaaacccugaagguggacuuccugagcaagcugcccgagaugcugaagauguucgaggaccggcugugccacaagaccuaccugaauggcgaccacgugacacaccccgacuucaugcuguacgacgcccuggauguggugcuguacauggaccccaugugccuggacgccuuuccaaagcucgugugcuucaagaagcggaucgaggccauuccucagaucgacaaguaccugaaguccagcaaguauaucgcuuggccccugcaaggcuggcaggccacauuuggaggcggagaucacccuccuaagaugagcaucagaggcgugggcggcaacggcaacagcagaaucccuagccacaacggcgacggcagcaacaggcggagccagaacaccaagggcaacaacaagguggaagauagagugugcagccuguacagcagccgguccaacgagaaccgcgagagcccuuaugccgugguggacguguccagcaugaucgagagcacccccaccagcggcgagacaaccagagcuaguagaggcgugcugagccgguuccagaggggccucgugcggauugcugacaaagugcggagagccgugcagugcgcuuggagcagcguguccacaagcagaagcagcgccacaagagccgccgagagcggcagcucuagcagaacagcuagaggcgccagcagcggcuacagagaguacagcccuucugccgcucggggccugcggcugauguucaccgacuuuuggcggacccgggugcugagacagaccucuccuauggccggcguguucggcaaccuggacgugaacgaggccagacugauggccgccuacaccagcgagugugccgaucaccuggaagccaaagagcuggccggaccugacggcguggcagccgcuagagaaaucgccaagagaugggagaagagagugcgggaccugcaggacaagggcgcugccagaaagcugcugaacgacccccugggcagacggacccccaacuaccagagcaagaaccccggcgaguacaccgugggcaacuccauguucuacgacggcccccagguggccaaccugcagaauguggauaccggcuucuggcuggacaugcagcaccugagcgacguggugcuguccagagagauccagaccggccugagagccagagccacccuggaagaguccaugcccaugcuggaaaaucuggaagagagauuccggcggcugcaggaaaccugcgacgccgccagaaccgagaucgaggaaagcggcuggacccgggaaagcgccuccagaauggaaggcgacgaagcccagggccccagcagagugcagcaggccuuucagagcuucgugaaugagugcaacagcaucgaguucagcuucggcuccuucggcgagcacgugcgggugcugugugccagagugucaagaggacuggccgcugccggcgaggccaucagaagaugcuucagcugcugcaagggcagcacccacagauacgcccccagagaugaccugucuccugagggcgccucucuggccgaaacccuggccagauucgccgacgacaugggcaucgaaagaggcgccgacggcaccuacgacaucccccugguggacgauuggagaaggggcgugccauccaucgagggcgagggcagcgauagcaucuacgagaucaugaugcccaucuacgaagugaugaacauggaccuggaaacccggcggagcuucgccgugcagcagggccauuaccaggaccccagagccagcgacuacgaccugccuagagccuccgauuacgaucugcccagaagccccuaccccaccccuccacugccucccagauaccagcugcagaacauggauguggaagccggcuuucgcgaggccguguacgccucuuuuguggccggcauguacaacuacgucgugacccagccccaggaacggauccccaauagccagcagguggaaggcauccugcgggacaugcugaccaacggcgaccagaccuuccgggaccugaugaagcgguggaacagagagguggaccgcgagcaccaccaucaccaccac

SEQ ID NO: 327 - RNA, 2505 nt, Artificial Sequence
  Synthetic Polynucleotide
auggaaaccccugcccagcugcuguuccugcugcugcuguggcugccugacaccaccggcaugagcccuauccucggcuacuggaagaucaaaggccuggugcagcccaccagacugcugcuggaauaccuggaagagaaguacgaggaacaccuguacgagcgcgacgagggcgauaaguggcggaacaagaaguucgagcugggccucgaguuccccaaccugccuuacuacaucgacggcgacgugaagcugacccagagcauggccaucauccgguauaucgccgacaagcacaacaugcucggcggcugcccuaaagagcgggccgagauuucuaugcuggaaggcgccgugcuggacaucagauacggcguguccagaaucgccuacagcaaggacuucgaaacccugaagguggacuuccugagcaagcugcccgagaugcugaagauguucgaggaccggcugugccacaagaccuaccugaauggcgaccacgugacacaccccgacuucaugcuguacgacgcccuggauguggugcuguacauggaccccaugugccuggacgccuuuccaaagcucgugugcuucaagaagcggaucgaggccauuccucagaucgacaaguaccugaaguccagcaaguauaucgcuuggccccugcaaggcuggcaggccacauuuggaggcggagaucacccuccuaagaugagcaucagaggcgugggcggcaacggcaacagcagaaucccuagccacaacggcgacggcagcaacaggcggagccagaacaccaagggcaacaacaagguggaagauagagugugcagccuguacagcagccgguccaacgagaaccgcgagagcccuuaugccgugguggacguguccagcaugaucgagagcacccccaccagcggcgagacaaccagagcuaguagaggcgugcugagccgguuccagaggggccucgugcggauugcugacaaagugcggagagccgugcagugcgcuuggagcagcguguccacaagcagaagcagcgccacaagagccgccgagagcggcagcucuagcagaacagcuagaggcgccagcagcggcuacagagaguacagcccuucugccgcucggggccugcggcugauguucaccgacuuuuggcggacccgggugcugagacagaccucuccuauggccggcguguucggcaaccuggacgugaacgaggccagacugauggccgccuacaccagcgagugugccgaucaccuggaagccaaagagcuggccggaccugacggcguggcagccgcuagagaaaucgccaagagaugggagaagagagugcgggaccugcaggacaagggcgcugccagaaagcugcugaacgacccccugggcagacggacccccaacuaccagagcaagaaccccggcgaguacaccgugggcaacuccauguucuacgacggcccccagguggccaaccugcagaauguggauaccggcuucuggcuggacaugagcaaccugagcgacguggugcuguccagagagauccagaccggccugagagccagagccacccuggaagaguccaugcccaugcuggaaaaucuggaagagagauuccggcggcugcaggaaaccugcgacgccgccagaaccgagaucgaggaaagcggcuggacccgggaaagcgccuccagaauggaaggcgacgaagcccagggccccagcagagugcagcaggccuuucagagcuucgugaaugagugcaacagcaucgaguucagcuucggcuccuucggcgagcacgugcgggugcugugugccagagugucaagaggacuggccgcugccggcgaggccaucagaagaugcuucagcugcugcaagggcagcacccacagauacgcccccagagaugaccugucuccugagggcgccucucuggccgaaacccuggccagauucgccgacgacaugggcaucgaaagaggcgccgacggcaccuacgacaucccccugguggacgauuggagaaggggcgugccauccaucgagggcgagggcagcgauagcaucuacgagaucaugaugcccaucuacgaagugaugaacauggaccuggaaacccggcggagcuucgccgugcagcagggccauuaccaggaccccagagccagcgacuacgaccugccuagagccuccgauuacgaucugcccagaagccccuaccccaccccuccacugccucccagauaccagcugcagaacauggauguggaagccggcuuucgcgaggccguguacgccucuuuuguggccggcauguacaacuacgucgugacccagccccaggaacggauccccaauagccagcagguggaaggcauccugcgggacaugcugaccaacggcagccagaccuuccgggaccugaugaagcgguggaacagagagguggaccgcgagcaccaccaucaccaccac

SEQ ID NO: 328 - RNA, 2487 nt, Artificial Sequence
  Synthetic Polynucleotide
auggaaaccccugcccagcugcuguuccugcugcugcuguggcugccugacaccaccggcaugagcccuauccucggcuacuggaagaucaaaggccuggugcagcccaccagacugcugcuggaauaccuggaagagaaguacgaggaacaccuguacgagcgcgacgagggcgauaaguggcggaacaagaaguucgagcugggccucgaguuccccaaccugccuuacuacaucgacggcgacgugaagcugacccagagcauggccaucauccgguauaucgccgacaagcacaacaugcucggcggcugcccuaaagagcgggccgagauuucuaugcuggaaggcgccgugcuggacaucagauacggcguguccagaaucgccuacagcaaggacuucgaaacccugaagguggacuuccugagcaagcugcccgagaugcugaagauguucgaggaccggcugugccacaagaccuaccugaauggcgaccacgugacacaccccgacuucaugcuguacgacgcccuggauguggugcuguacauggaccccaugugccuggacgccuuuccaaagcucgugugcuucaagaagcggaucgaggccauuccucagaucgacaaguaccugaaguccagcaaguauaucgcuuggccccugcaaggcuggcaggccacauuuggaggcggagaucacccuccuaagaugagcaucagaggcgugggcggcaacggcaacagcagaaucccuagccacaacggcgacggcagcaacaggcggagccagaacaccaagggcaacaacaagguggaagauagagugugcagccuguacagcagccgguccaacgagaaccgcgagagcccuuaugccgugguggacguguccagcaugaucgagagcacccccaccagcggcgagacaaccagagcuaguagaggcgugcugagccgguuccagaggggccucgugcggauugcugacaaagugcggagagccgugcagugcgcuuggagcagcguguccacaagcagaagcagcgccacaagagccgccgagagcggcagcucuagcagaacagcuagaggcgccagcagcggcuacagagaguacagcccuucugccgcucggggccugcggcugauguucaccgacuuuuggcggacccgggugcugagacagaccucuccuauggccggcguguucggcaaccuggacgugaacgaggccagacugauggccgccuacaccagcgagugugccgaucaccuggaagccaaagagcuggccggaccugacggcguggcagccgcuagagaaaucgccaagagaugggagaagagagugcgggaccugcaggacaagggcgcugccagaaagcugcugaacgacccccugggcagacggacccccaacuaccagagcaagaaccccggcgaguacaccgugggcaacuccauguucuacgacggcccccagguggccaaccugcagaauguggauaccggcuucuggcuggacaugcagcaccugagcgacguggugcuguccagagagauccagaccggccugagagccagagccacccuggaagaguccaugcccaugcuggaaaaucuggaagagagauuccggcggcugcaggaaaccugcgacgccgccagaaccgagaucgaggaaagcggcuggacccgggaaagcgccuccagaauggaaggcgacgaagcccagggccccagcagagugcagcaggccuuucagagcuucgugaaugagugcaacagcaucgaguucagcuucggcuccuucggcgagcacgugcgggugcugugugccagagugucaagaggacuggccgcugccggcgaggccaucagaagaugcuucagcugcugcaagggcagcacccacagauacgcccccagagaugaccugucuccugagggcgccucucuggccgaaacccuggccagauucgccgacgacaugggcaucgaaagaggcgccgacggcaccuacgacaucccccugguggacgauuggagaaggggcgugccauccaucgagggcgagggcagcgauagcaucuacgagaucaugaugcccaucuacgaagugaugaacauggaccuggaaacccggcggagcuucgccgugcagcagggccauuaccaggaccccagagccagcgacuacgaccugccuagagccuccgauuacgaucugcccagaagccccuaccccaccccuccacugccucccagauaccagcugcagaacauggauguggaagccggcuuucgcgaggccguguacgccucuuuuguggccggcauguacaacuacgucgugacccagccccaggaacggauccccaauagccagcagguggaaggcauccugcgggacaugcugaccaacggcgaccagaccuuccgggaccugaugaagcgguggaacagagagguggaccgcgag

SEQ ID NO: 329 - RNA, 2487 nt, Artificial Sequence
  Synthetic Polynucleotide
auggaaaccccugcccagcugcuguuccugcugcugcuguggcugccugacaccaccggcaugagcccuauccucggcuacuggaagaucaaaggccuggugcagcccaccagacugcugcuggaauaccuggaagagaaguacgaggaacaccuguacgagcgcgacgagggcgauaaguggcggaacaagaaguucgagcugggccucgaguuccccaaccugccuuacuacaucgacggcgacgugaagcugacccagagcauggccaucauccgguauaucgccgacaagcacaacaugcucggcggcugcccuaaagagcgggccgagauuucuaugcuggaaggcgccgugcuggacaucagauacggcguguccagaaucgccuacagcaaggacuucgaaacccugaagguggacuuccugagcaagcugcccgagaugcugaagauguucgaggaccggcugugccacaagaccuaccugaauggcgaccacgugacacaccccgacuucaugcuguacgacgcccuggauguggugcuguacauggaccccaugugccuggacgccuuuccaaagcucgugugcuucaagaagcggaucgaggccauuccucagaucgacaaguaccugaaguccagcaaguauaucgcuuggccccugcaaggcuggcaggccacauuuggaggcggagaucacccuccuaagaugagcaucagaggcgugggcggcaacggcaacagcagaaucccuagccacaacggcgacggcagcaacaggcggagccagaacaccaagggcaacaacaagguggaagauagagugugcagccuguacagcagccgguccaacgagaaccgcgagagcccuuaugccgugguggacguguccagcaugaucgagagcacccccaccagcggcgagacaaccagagcuaguagaggcgugcugagccgguuccagaggggccucgugcggauugcugacaaagugcggagagccgugcagugcgcuuggagcagcguguccacaagcagaagcagcgccacaagagccgccgagagcggcagcucuagcagaacagcuagaggcgccagcagcggcuacagagaguacagcccuucugccgcucggggccugcggcugauguucaccgacuuuuggcggacccgggugcugagacagaccucuccuauggccggcguguucggcaaccuggacgugaacgaggccagacugauggccgccuacaccagcgagugugccgaucaccuggaagccaaagagcuggccggaccugacggcguggcagccgcuagagaaaucgccaagagaugggagaagagagugcgggaccugcaggacaagggcgcugccagaaagcugcugaacgacccccugggcagacggacccccaacuaccagagcaagaaccccggcgaguacaccgugggcaacuccauguucuacgacggcccccagguggccaaccugcagaauguggauaccggcuucuggcuggacaugagcaaccugagcgacguggugcuguccagagagauccagaccggccugagagccagagccacccuggaagaguccaugcccaugcuggaaaaucuggaagagagauuccggcggcugcaggaaaccugcgacgccgccagaaccgagaucgaggaaagcggcuggacccgggaaagcgccuccagaauggaaggcgacgaagcccagggccccagcagagugcagcaggccuuucagagcuucgugaaugagugcaacagcaucgaguucagcuucggcuccuucggcgagcacgugcgggugcugugugccagagugucaagaggacuggccgcugccggcgaggccaucagaagaugcuucagcugcugcaagggcagcacccacagauacgcccccagagaugaccugucuccugagggcgccucucuggccgaaacccuggccagauucgccgacgacaugggcaucgaaagaggcgccgacggcaccuacgacaucccccugguggacgauuggagaaggggcgugccauccaucgagggcgagggcagcgauagcaucuacgagaucaugaugcccaucuacgaagugaugaacauggaccuggaaacccggcggagcuucgccgugcagcagggccauuaccaggaccccagagccagcgacuacgaccugccuagagccuccgauuacgaucugcccagaagccccuaccccaccccuccacugccucccagauaccagcugcagaacauggauguggaagccggcuuucgcgaggccguguacgccucuuuuguggccggcauguacaacuacgucgugacccagccccaggaacggauccccaauagccagcagguggaaggcauccugcgggacaugcugaccaacggcagccagaccuuccgggaccugaugaagcgguggaacagagagguggaccgcgag

SEQ ID NO: 330 - RNA, 1800 nt, Artificial Sequence
  Synthetic Polynucleotide
auggaaaccccugcccagcugcuguuccugcugcugcuguggcugccugacaccaccggcaugagcaucagaggcgugggcggcaacggcaacagcagaaucccuagccacaacggcgacggcagcaacaggcggagccagaacaccaagggcaacaacaagguggaagauagagugugcagccuguacagcagccgguccaacgagaaccgcgagagcccuuaugccgugguggacguguccagcaugaucgagagcacccccaccagcggcgagacaaccagagcuaguagaggcgugcugagccgguuccagaggggccucgugcggauugcugacaaagugcggagagccgugcagugcgcuuggagcagcguguccacaagcagaagcagcgccacaagagccgccgagagcggcagcucuagcagaacagcuagaggcgccagcagcggcuacagagaguacagcccuucugccgcucggggccugcggcugauguucaccgacuuuuggcggacccgggugcugagacagaccucuccuauggccggcguguucggcaaccuggacgugaacgaggccagacugauggccgccuacaccagcgagugugccgaucaccuggaagccaaagagcuggccggaccugacggcguggcagccgcuagagaaaucgccaagagaugggagaagagagugcgggaccugcaggacaagggcgcugccagaaagcugcugaacgacccccugggcagacggacccccaacuaccagagcaagaaccccggcgaguacaccgugggcaacuccauguucuacgacggcccccagguggccaaccugcagaauguggauaccggcuucuggcuggacaugcagcaccugagcgacguggugcuguccagagagauccagaccggccugagagccagagccacccuggaagaguccaugcccaugcuggaaaaucuggaagagagauuccggcggcugcaggaaaccugcgacgccgccagaaccgagaucgaggaaagcggcuggacccgggaaagcgccuccagaauggaaggcgacgaagcccagggccccagcagagugcagcaggccuuucagagcuucgugaaugagugcaacagcaucgaguucagcuucggcuccuucggcgagcacgugcgggugcugugugccagagugucaagaggacuggccgcugccggcgaggccaucagaagaugcuucagcugcugcaagggcagcacccacagauacgcccccagagaugaccugucuccugagggcgccucucuggccgaaacccuggccagauucgccgacgacaugggcaucgaaagaggcgccgacggcaccuacgacaucccccugguggacgauuggagaaggggcgugccauccaucgagggcgagggcagcgauagcaucuacgagaucaugaugcccaucuacgaagugaugaacauggaccuggaaacccggcggagcuucgccgugcagcagggccauuaccaggaccccagagccagcgacuacgaccugccuagagccuccgauuacgaucugcccagaagccccuaccccaccccuccacugccucccagauaccagcugcagaacauggauguggaagccggcuuucgcgaggccguguacgccucuuuuguggccggcauguacaacuacgucgugacccagccccaggaacggauccccaauagccagcagguggaaggcauccugcgggacaugcugaccaacggcgaccaccaccaucaccaccac

SEQ ID NO: 331 - RNA, 1452 nt, Artificial Sequence
  Synthetic Polynucleotide
auggaaaccccugcccagcugcuguuccugcugcugcuguggcugccugacaccaccggcaugagcaucagaggcgugggcggcaacggcaacagcagaaucccuagccacaacggcgacggcagcaacaggcggagccagaacaccaagggcaacaacaagguggaagauagagugugcagccuguacagcagccgguccaacgagaaccgcgagagcccuuaugccgugguggacguguccagcaugaucgagagcacccccaccagcggcgagacaaccagagcuaguagaggcgugcugagccgguuccagaggggccucgugcggauugcugacaaagugcggagagccgugcagugcgcuuggagcagcguguccacaagcagaagcagcgccacaagagccgccgagagcggcagcucuagcagaacagcuagaggcgccagcagcggcuacagagaguacagcccuucugccgcucggggccugcggcugauguucaccgacuuuuggcggacccgggugcugagacagaccucuccuauggccggcguguucggcaaccuggacgugaacgaggccagacugauggccgccuacaccagcgagugugccgaucaccuggaagccaaagagcuggccggaccugacggcguggcagccgcuagagaaaucgccaagagaugggagaagagagugcgggaccugcaggacaagggcgcugccagaaagcugcugaacgacccccugggcagacggacccccaacuaccagagcaagaaccccggcgaguacaccgugggcaacuccauguucuacgacggcccccagguggccaaccugcagaauguggauaccggcuucuggcuggacaugcagcaccugagcgacguggugcuguccagagagauccagaccggccugagagccagagccacccuggaagaguccaugcccaugcuggaaaaucuggaagagagauuccggcggcugcaggaaaccugcgacgccgccagaaccgagaucgaggaaagcggcuggacccgggaaagcgccuccagaauggaaggcgacgaagcccagggccccagcagagugcagcaggccuuucagagcuucgugaaugagugcaacagcaucgaguucagcuucggcuccuucggcgagcacgugcgggugcugugugccagagugucaagaggacuggccgcugccggcgaggccaucagaagaugcuucagcugcugcaagggcagcacccacagauacgcccccagagaugaccugucuccugagggcgccucucuggccgaaacccuggccagauucgccgacgacaugggcaucgaaagaggcgccgacggcaccuacgacaucccccugguggacgauuggagaaggggcgugccauccaucgagggcgagggcagccaccaccaucaccaccac

SEQ ID NO: 332 - RNA, 1800 nt, Artificial Sequence
  Synthetic Polynucleotide
auggaaaccccugcccagcugcuguuccugcugcugcuguggcugccugacaccaccggcaugagcaucagaggcgugggcggcaacggcaacagcagaaucccuagccacaacggcgacggcagcaacaggcggagccagaacaccaagggcaacaacaagguggaagauagagugugcagccuguacagcagccgguccaacgagaaccgcgagagcccuuaugccgugguggacguguccagcaugaucgagagcacccccaccagcggcgagacaaccagagcuaguagaggcgugcugagccgguuccagaggggccucgugcggauugcugacaaagugcggagagccgugcagugcgcuuggagcagcguguccacaagcagaagcagcgccacaagagccgccgagagcggcagcucuagcagaacagcuagaggcgccagcagcggcuacagagaguacagcccuucugccgcucggggccugcggcugauguucaccgacuuuuggcggacccgggugcugagacagaccucuccuauggccggcguguucggcaaccuggacgugaacgaggccagacugauggccgccuacaccagcgagugugccgaucaccuggaagccaaagagcuggccggaccugacggcguggcagccgcuagagaaaucgccaagagaugggagaagagagugcgggaccugcaggacaagggcgcugccagaaagcugcugaacgacccccugggcagacggacccccaacuaccagagcaagaaccccggcgaguacaccgugggcaacuccauguucuacgacggcccccagguggccaaccugcagaauguggauaccggcuucuggcuggacaugagcaaccugagcgacguggugcuguccagagagauccagaccggccugagagccagagccacccuggaagaguccaugcccaugcuggaaaaucuggaagagagauuccggcggcugcaggaaaccugcgacgccgccagaaccgagaucgaggaaagcggcuggacccgggaaagcgccuccagaauggaaggcgacgaagcccagggccccagcagagugcagcaggccuuucagagcuucgugaaugagugcaacagcaucgaguucagcuucggcuccuucggcgagcacgugcgggugcugugugccagagugucaagaggacuggccgcugccggcgaggccaucagaagaugcuucagcugcugcaagggcagcacccacagauacgcccccagagaugaccugucuccugagggcgccucucuggccgaaacccuggccagauucgccgacgacaugggcaucgaaagaggcgccgacggcaccuacgacaucccccugguggacgauuggagaaggggcgugccauccaucgagggcgagggcagcgauagcaucuacgagaucaugaugcccaucuacgaagugaugaacauggaccuggaaacccggcggagcuucgccgugcagcagggccauuaccaggaccccagagccagcgacuacgaccugccuagagccuccgauuacgaucugcccagaagccccuaccccaccccuccacugccucccagauaccagcugcagaacauggauguggaagccggcuuucgcgaggccguguacgccucuuuuguggccggcauguacaacuacgucgugacccagccccaggaacggauccccaauagccagcagguggaaggcauccugcgggacaugcugaccaacggcagccaccaccaucaccaccac

SEQ ID NO: 333 - RNA, 1452 nt, Artificial Sequence
  Synthetic Polynucleotide
auggaaaccccugcccagcugcuguuccugcugcugcuguggcugccugacaccaccggcaugagcaucagaggcgugggcggcaacggcaacagcagaaucccuagccacaacggcgacggcagcaacaggcggagccagaacaccaagggcaacaacaagguggaagauagagugugcagccuguacagcagccgguccaacgagaaccgcgagagcccuuaugccgugguggacguguccagcaugaucgagagcacccccaccagcggcgagacaaccagagcuaguagaggcgugcugagccgguuccagaggggccucgugcggauugcugacaaagugcggagagccgugcagugcgcuuggagcagcguguccacaagcagaagcagcgccacaagagccgccgagagcggcagcucuagcagaacagcuagaggcgccagcagcggcuacagagaguacagcccuucugccgcucggggccugcggcugauguucaccgacuuuuggcggacccgggugcugagacagaccucuccuauggccggcguguucggcaaccuggacgugaacgaggccagacugauggccgccuacaccagcgagugugccgaucaccuggaagccaaagagcuggccggaccugacggcguggcagccgcuagagaaaucgccaagagaugggagaagagagugcgggaccugcaggacaagggcgcugccagaaagcugcugaacgacccccugggcagacggacccccaacuaccagagcaagaaccccggcgaguacaccgugggcaacuccauguucuacgacggcccccagguggccaaccugcagaauguggauaccggcuucuggcuggacaugagcaaccugagcgacguggugcuguccagagagauccagaccggccugagagccagagccacccuggaagaguccaugcccaugcuggaaaaucuggaagagagauuccggcggcugcaggaaaccugcgacgccgccagaaccgagaucgaggaaagcggcuggacccgggaaagcgccuccagaauggaaggcgacgaagcccagggccccagcagagugcagcaggccuuucagagcuucgugaaugagugcaacagcaucgaguucagcuucggcuccuucggcgagcacgugcgggugcugugugccagagugucaagaggacuggccgcugccggcgaggccaucagaagaugcuucagcugcugcaagggcagcacccacagauacgcccccagagaugaccugucuccugagggcgccucucuggccgaaacccuggccagauucgccgacgacaugggcaucgaaagaggcgccgacggcaccuacgacaucccccugguggacgauuggagaaggggcgugccauccaucgagggcgagggcagccaccaccaucaccaccac

SEQ ID NO: 334 - RNA, 1782 nt, Artificial Sequence
  Synthetic Polynucleotide
auggaaaccccugcccagcugcuguuccugcugcugcuguggcugccugacaccaccggcaugagcaucagaggcgugggcggcaacggcaacagcagaaucccuagccacaacggcgacggcagcaacaggcggagccagaacaccaagggcaacaacaagguggaagauagagugugcagccuguacagcagccgguccaacgagaaccgcgagagcccuuaugccgugguggacguguccagcaugaucgagagcacccccaccagcggcgagacaaccagagcuaguagaggcgugcugagccgguuccagaggggccucgugcggauugcugacaaagugcggagagccgugcagugcgcuuggagcagcguguccacaagcagaagcagcgccacaagagccgccgagagcggcagcucuagcagaacagcuagaggcgccagcagcggcuacagagaguacagcccuucugccgcucggggccugcggcugauguucaccgacuuuuggcggacccgggugcugagacagaccucuccuauggccggcguguucggcaaccuggacgugaacgaggccagacugauggccgccuacaccagcgagugugccgaucaccuggaagccaaagagcuggccggaccugacggcguggcagccgcuagagaaaucgccaagagaugggagaagagagugcgggaccugcaggacaagggcgcugccagaaagcugcugaacgacccccugggcagacggacccccaacuaccagagcaagaaccccggcgaguacaccgugggcaacuccauguucuacgacggcccccagguggccaaccugcagaauguggauaccggcuucuggcuggacaugcagcaccugagcgacguggugcuguccagagagauccagaccggccugagagccagagccacccuggaagaguccaugcccaugcuggaaaaucuggaagagagauuccggcggcugcaggaaaccugcgacgccgccagaaccgagaucgaggaaagcggcuggacccgggaaagcgccuccagaauggaaggcgacgaagcccagggccccagcagagugcagcaggccuuucagagcuucgugaaugagugcaacagcaucgaguucagcuucggcuccuucggcgagcacgugcgggugcugugugccagagugucaagaggacuggccgcugccggcgaggccaucagaagaugcuucagcugcugcaagggcagcacccacagauacgcccccagagaugaccugucuccugagggcgccucucuggccgaaacccuggccagauucgccgacgacaugggcaucgaaagaggcgccgacggcaccuacgacaucccccugguggacgauuggagaaggggcgugccauccaucgagggcgagggcagcgauagcaucuacgagaucaugaugcccaucuacgaagugaugaacauggaccuggaaacccggcggagcuucgccgugcagcagggccauuaccaggaccccagagccagcgacuacgaccugccuagagccuccgauuacgaucugcccagaagccccuaccccaccccuccacugccucccagauaccagcugcagaacauggauguggaagccggcuuucgcgaggccguguacgccucuuuuguggccggcauguacaacuacgucgugacccagccccaggaacggauccccaauagccagcagguggaaggcauccugcgggacaugcugaccaacggcgac

SEQ ID NO: 335 - RNA, 1434 nt, Artificial Sequence
  Synthetic Polynucleotide
auggaaaccccugcccagcugcuguuccugcugcugcuguggcugccugacaccaccggcaugagcaucagaggcgugggcggcaacggcaacagcagaaucccuagccacaacggcgacggcagcaacaggcggagccagaacaccaagggcaacaacaagguggaagauagagugugcagccuguacagcagccgguccaacgagaaccgcgagagcccuuaugccgugguggacguguccagcaugaucgagagcacccccaccagcggcgagacaaccagagcuaguagaggcgugcugagccgguuccagaggggccucgugcggauugcugacaaagugcggagagccgugcagugcgcuuggagcagcguguccacaagcagaagcagcgccacaagagccgccgagagcggcagcucuagcagaacagcuagaggcgccagcagcggcuacagagaguacagcccuucugccgcucggggccugcggcugauguucaccgacuuuuggcggacccgggugcugagacagaccucuccuauggccggcguguucggcaaccuggacgugaacgaggccagacugauggccgccuacaccagcgagugugccgaucaccuggaagccaaagagcuggccggaccugacggcguggcagccgcuagagaaaucgccaagagaugggagaagagagugcgggaccugcaggacaagggcgcugccagaaagcugcugaacgacccccugggcagacggacccccaacuaccagagcaagaaccccggcgaguacaccgugggcaacuccauguucuacgacggcccccagguggccaaccugcagaauguggauaccggcuucuggcuggacaugcagcaccugagcgacguggugcuguccagagagauccagaccggccugagagccagagccacccuggaagaguccaugcccaugcuggaaaaucuggaagagagauuccggcggcugcaggaaaccugcgacgccgccagaaccgagaucgaggaaagcggcuggacccgggaaagcgccuccagaauggaaggcgacgaagcccagggccccagcagagugcagcaggccuuucagagcuucgugaaugagugcaacagcaucgaguucagcuucggcuccuucggcgagcacgugcgggugcugugugccagagugucaagaggacuggccgcugccggcgaggccaucagaagaugcuucagcugcugcaagggcagcacccacagauacgcccccagagaugaccugucuccugagggcgccucucuggccgaaacccuggccagauucgccgacgacaugggcaucgaaagaggcgccgacggcaccuacgacaucccccugguggacgauuggagaaggggcgugccauccaucgagggcgagggcagc

SEQ ID NO: 336 - RNA, 1782 nt, Artificial Sequence
  Synthetic Polynucleotide
auggaaaccccugcccagcugcuguuccugcugcugcuguggcugccugacaccaccggcaugagcaucagaggcgugggcggcaacggcaacagcagaaucccuagccacaacggcgacggcagcaacaggcggagccagaacaccaagggcaacaacaagguggaagauagagugugcagccuguacagcagccgguccaacgagaaccgcgagagcccuuaugccgugguggacguguccagcaugaucgagagcacccccaccagcggcgagacaaccagagcuaguagaggcgugcugagccgguuccagaggggccucgugcggauugcugacaaagugcggagagccgugcagugcgcuuggagcagcguguccacaagcagaagcagcgccacaagagccgccgagagcggcagcucuagcagaacagcuagaggcgccagcagcggcuacagagaguacagcccuucugccgcucggggccugcggcugauguucaccgacuuuuggcggacccgggugcugagacagaccucuccuauggccggcguguucggcaaccuggacgugaacgaggccagacugauggccgccuacaccagcgagugugccgaucaccuggaagccaaagagcuggccggaccugacggcguggcagccgcuagagaaaucgccaagagaugggagaagagagugcgggaccugcaggacaagggcgcugccagaaagcugcugaacgacccccugggcagacggacccccaacuaccagagcaagaaccccggcgaguacaccgugggcaacuccauguucuacgacggcccccagguggccaaccugcagaauguggauaccggcuucuggcuggacaugagcaaccugagcgacguggugcuguccagagagauccagaccggccugagagccagagccacccuggaagaguccaugcccaugcuggaaaaucuggaagagagauuccggcggcugcaggaaaccugcgacgccgccagaaccgagaucgaggaaagcggcuggacccgggaaagcgccuccagaauggaaggcgacgaagcccagggccccagcagagugcagcaggccuuucagagcuucgugaaugagugcaacagcaucgaguucagcuucggcuccuucggcgagcacgugcgggugcugugugccagagugucaagaggacuggccgcugccggcgaggccaucagaagaugcuucagcugcugcaagggcagcacccacagauacgcccccagagaugaccugucuccugagggcgccucucuggccgaaacccuggccagauucgccgacgacaugggcaucgaaagaggcgccgacggcaccuacgacaucccccugguggacgauuggagaaggggcgugccauccaucgagggcgagggcagcgauagcaucuacgagaucaugaugcccaucuacgaagugaugaacauggaccuggaaacccggcggagcuucgccgugcagcagggccauuaccaggaccccagagccagcgacuacgaccugccuagagccuccgauuacgaucugcccagaagccccuaccccaccccuccacugccucccagauaccagcugcagaacauggauguggaagccggcuuucgcgaggccguguacgccucuuuuguggccggcauguacaacuacgucgugacccagccccaggaacggauccccaauagccagcagguggaaggcauccugcgggacaugcugaccaacggcagc

SEQ ID NO: 337 - RNA, 1434 nt, Artificial Sequence
  Synthetic Polynucleotide
auggaaaccccugcccagcugcuguuccugcugcugcuguggcugccugacaccaccggcaugagcaucagaggcgugggcggcaacggcaacagcagaaucccuagccacaacggcgacggcagcaacaggcggagccagaacaccaagggcaacaacaagguggaagauagagugugcagccuguacagcagccgguccaacgagaaccgcgagagcccuuaugccgugguggacguguccagcaugaucgagagcacccccaccagcggcgagacaaccagagcuaguagaggcgugcugagccgguuccagaggggccucgugcggauugcugacaaagugcggagagccgugcagugcgcuuggagcagcguguccacaagcagaagcagcgccacaagagccgccgagagcggcagcucuagcagaacagcuagaggcgccagcagcggcuacagagaguacagcccuucugccgcucggggccugcggcugauguucaccgacuuuuggcggacccgggugcugagacagaccucuccuauggccggcguguucggcaaccuggacgugaacgaggccagacugauggccgccuacaccagcgagugugccgaucaccuggaagccaaagagcuggccggaccugacggcguggcagccgcuagagaaaucgccaagagaugggagaagagagugcgggaccugcaggacaagggcgcugccagaaagcugcugaacgacccccugggcagacggacccccaacuaccagagcaagaaccccggcgaguacaccgugggcaacuccauguucuacgacggcccccagguggccaaccugcagaauguggauaccggcuucuggcuggacaugagcaaccugagcgacguggugcuguccagagagauccagaccggccugagagccagagccacccuggaagaguccaugcccaugcuggaaaaucuggaagagagauuccggcggcugcaggaaaccugcgacgccgccagaaccgagaucgaggaaagcggcuggacccgggaaagcgccuccagaauggaaggcgacgaagcccagggccccagcagagugcagcaggccuuucagagcuucgugaaugagugcaacagcaucgaguucagcuucggcuccuucggcgagcacgugcgggugcugugugccagagugucaagaggacuggccgcugccggcgaggccaucagaagaugcuucagcugcugcaagggcagcacccacagauacgcccccagagaugaccugucuccugagggcgccucucuggccgaaacccuggccagauucgccgacgacaugggcaucgaaagaggcgccgacggcaccuacgacaucccccugguggacgauuggagaaggggcgugccauccaucgagggcgagggcagc

SEQ ID NO: 338 - RNA, 1800 nt, Artificial Sequence
  Synthetic Polynucleotide
auggaaaccccugcucagcugcuguuccugcugcugcuguggcugccugauaccaccggcaugucuaucagaggcguuggcggcaacggcaacagcagaaucccuagccauaauggcgacggcagcaacaggcggagccagaauaccaagggcaacaacaagguggaagaucgcgugugcagccuguacagcuccagaagcaacgagaaccgcgagagcccuuaugccgugguggauguguccagcaugaucgagagcaccccuaccagcggcgagacaacaagagcuaguagaggcgugcugagccgguuucagagaggccucguucggaucgcugacaaagugcggagagccgugcagugugccuggucuaguguguccacaagcagaagcagcgccacaagagccgccgagagcggaucuucuagcagaacagcuagaggcgccagcagcggcuacagagaguauucuccaucugccgccagaggccugcggcugauguuuacagauuucuggcggacccgggugcugagacagacaucuccuauggcuggcguguucggcaaccuggaugugaaugaggccagacugauggccgccuacacaagcgaaugugccgaucaccuggaagccaaagagcuggcuggaccugacgguguugccgccgcuagagaaaucgccaagagaugggagaagagagugcgggaccugcaggauaagggcgcugcuagaaagcugcugaacgacccucugggcagaagaaccccuaacuaccagagcaagaaccccggcgaguacaccgugggcaacuccauguucuacgacggaccccagguggccaaccugcagaauguggauacaggcuucuggcuggauaugcagcaccugagcgacguggugcuguccagagagauccagacaggccugagagccagagccacacuggaagaguccaugccuaugcucgagaaccuggaagagagauuccggcggcugcaagagacaugugacgccgccagaaccgagaucgaggaaagcggcuggacaagagaaagcgccuccagaauggaaggcgacgaagcccaaggaccuagcagagugcagcaggccuuccagagcuucgugaacgagugcaacagcaucgaguucagcuucggcuccuucggcgaacaugugcgggugcugugugccagaguuagcagaggacuugcugccgcuggcgaggccaucagaagaugcuucucuugcugcaagggcagcacccacagauacgccccuagagaugaucugagcccugagggcgcuucucuggccgaaacacuggccagauucgccgacgauaugggcauugaaagaggcgccgacggaaccuacgacaucccucugguggacgauuggagaaggggcgugccaucuaucgaaggcgagggcagcgauagcaucuacgagaucaugaugcccaucuacgaagugaugaacauggaccuggaaacccggcggagcuuugccgugcagcaaggccauuaccaggauccuagagccagcgacuacgaccugccuagagccuccgauuaugaucugccucggagccccuauccuacaccuccucugccuccaagauaccagcuucagaauauggacguggaagccggauuccgcgaggccguguaugcuagcuuuguggccggcauguacaacuacguggucacccagccucaagagagaauccccaacagccagcaggucgagggcauccugagagauaugcugaccaacggcgaccaccaccaucaccaucau

SEQ ID NO: 339 - RNA, 2529 nt, Artificial Sequence
  Synthetic Polynucleotide
auggaaaccccugcucagcugcuguuccugcugcugcuguggcugccugauacaaccggcgagccuaagagcugcgacaagacccacaccuguccuccauguccugcuccagaacugcucggcggaccuuccguguuccuguuuccuccaaagccuaaggacacccugaugaucagcagaaccccugaagugaccugcguggugguggaugugucccacgaggaucccgaagugaaguucaauugguacguggacggcguggaagugcacaacgccaagaccaagccuagagaggaacaguacaacagcaccuacagagugguguccgugcugaccgugcugcaccaggauuggcugaacggcaaagaguacaagugcaagguguccaacaaggcccugccugcuccuaucgagaagaccaucagcaaggccaagggccagccaagagaaccccagguguacacacugccuccaagcagagaugagcugaccaagaaccaggugucccugaccugucuggucaagggcuucuaccccuccgauaucgccguggaaugggagagcaauggccagccugagaacaacuacaagacaaccccuccugugcuggacagcgacggcucauucuuccuguacagcaagcugacaguggacaagagcagauggcagcagggcaacguguucagcugcagcgugaugcacgaggcccugcacaaucacuacacccagaagucccugucucugagccccggcaagaugagcaucagaggcguuggcggcaacggcaacagcagaaucccuagccauaauggcgacggcagcaacaggcggagccagaauaccaagggcaacaacaagguggaagaucgcgugugcagccuguacuccagcagaagcaacgagaaccgcgagagcccuuaugccguggucgacguguccagcaugaucgagagcacaccuaccagcggcgagacaaccagagcuaguagaggcgugcugagccgguuucagagaggccucguucggaucgcugacaaagugcggagagccgugcagugugccuggucuaguguguccaccagcagauccucugccacaagagccgccgagucuggcagcucuagcagaacagcuagaggcgccagcagcggcuacagagaguauucuccaucugccgccagaggccugcggcugauguuuacagauuucuggcggacccgggugcugagacagacaucuccuauggcuggcguguucggcaaccuggaugugaaugaggccagacugauggccgccuacacaagcgaaugugccgaucaccuggaagccaaagagcuggcuggaccugacgguguugccgccgcuagagaaaucgccaagagaugggagaagagagugcgggaccugcaggauaagggcgcugcuagaaagcugcugaacgacccucugggcagaagaaccccuaacuaccagagcaagaaccccggcgaguacaccgugggcaacuccauguucuacgacggaccucagguggccaaccugcagaauguggauaccggcuucuggcuggauaugcagcaccuguccgauguggugcuguccagagagauccagaccggccugagagccagagccacacuggaagaguccaugccuaugcucgagaaccuggaagagagauuccggcggcugcaagagacaugugacgccgccagaaccgagaucgaggaaagcggcuggaccagagaaagcgccuccagaauggaaggcgacgaagcccaaggaccuagcagagugcagcaggccuuccagagcuucgugaacgagugcaacagcaucgaguucagcuucggcuccuucggcgaacaugugcgggugcugugugccagaguuagcagaggacuugcugccgcuggcgaggccaucagaagaugcuucucuugcugcaagggcagcacccacagauacgccccuagagaugaucugagcccugagggcgcaucucuggccgaaacacuggccagauucgccgacgauaugggcauugaaagaggcgccgacggaaccuacgacaucccucugguggacgauuggagaaggggcgugccaucuaucgaaggcgagggcagcgauagcaucuacgagaucaugaugcccaucuacgaagugaugaacauggaccuggaaacccggcggagcuucgcuguucagcagggccauuaccaggauccuagagccagcgacuacgaccugccuagagccuccgauuaugaucugccucggagccccuauccuacaccuccacugccaccuagauaccagcuccagaauauggacguggaagccggauuccgcgaggccguguaugcuagcuuuguggccggcauguacaacuacguggucacccagccucaagagcggauccccaauucucagcaggucgagggcauccugagggacaugcugaccaauggcgaccagaccuuccgggaccugaugaagagauggaacagagagguggacagagag

SEQ ID NO: 340 - RNA, 2547 nt, Artificial Sequence
  Synthetic Polynucleotide
auggaaaccccugcucagcugcuguuccugcugcugcuguggcugccugauacaaccggcgagccuaagagcugcgacaagacccacaccuguccuccauguccugcuccagaacugcucggcggaccuuccguguuccuguuuccuccaaagccuaaggacacccugaugaucagcagaaccccugaagugaccugcguggugguggaugugucccacgaggaucccgaagugaaguucaauugguacguggacggcguggaagugcacaacgccaagaccaagccuagagaggaacaguacaacagcaccuacagagugguguccgugcugaccgugcugcaccaggauuggcugaacggcaaagaguacaagugcaagguguccaacaaggcccugccugcuccuaucgagaagaccaucagcaaggccaagggccagccaagagaaccccagguguacacacugccuccaagcagagaugagcugaccaagaaccaggugucccugaccugucuggucaagggcuucuaccccuccgauaucgccguggaaugggagagcaauggccagccugagaacaacuacaagacaaccccuccugugcuggacagcgacggcucauucuuccuguacagcaagcugacaguggacaagagcagauggcagcagggcaacguguucagcugcagcgugaugcacgaggcccugcacaaucacuacacccagaagucccugucucugagccccggcaagaugagcaucagaggcguuggcggcaacggcaacagcagaaucccuagccauaauggcgacggcagcaacaggcggagccagaauaccaagggcaacaacaagguggaagaucgcgugugcagccuguacuccagcagaagcaacgagaaccgcgagagcccuuaugccguggucgacguguccagcaugaucgagagcacaccuaccagcggcgagacaaccagagcuaguagaggcgugcugagccgguuucagagaggccucguucggaucgcugacaaagugcggagagccgugcagugugccuggucuaguguguccaccagcagauccucugccacaagagccgccgagucuggcagcucuagcagaacagcuagaggcgccagcagcggcuacagagaguauucuccaucugccgccagaggccugcggcugauguuuacagauuucuggcggacccgggugcugagacagacaucuccuauggcuggcguguucggcaaccuggaugugaaugaggccagacugauggccgccuacacaagcgaaugugccgaucaccuggaagccaaagagcuggcuggaccugacgguguugccgccgcuagagaaaucgccaagagaugggagaagagagugcgggaccugcaggauaagggcgcugcuagaaagcugcugaacgacccucugggcagaagaaccccuaacuaccagagcaagaaccccggcgaguacaccgugggcaacuccauguucuacgacggaccucagguggccaaccugcagaauguggauaccggcuucuggcuggauaugcagcaccuguccgauguggugcuguccagagagauccagaccggccugagagccagagccacacuggaagaguccaugccuaugcucgagaaccuggaagagagauuccggcggcugcaagagacaugugacgccgccagaaccgagaucgaggaaagcggcuggaccagagaaagcgccuccagaauggaaggcgacgaagcccaaggaccuagcagagugcagcaggccuuccagagcuucgugaacgagugcaacagcaucgaguucagcuucggcuccuucggcgaacaugugcgggugcugugugccagaguuagcagaggacuugcugccgcuggcgaggccaucagaagaugcuucucuugcugcaagggcagcacccacagauacgccccuagagaugaucugagcccugagggcgcaucucuggccgaaacacuggccagauucgccgacgauaugggcauugaaagaggcgccgacggaaccuacgacaucccucugguggacgauuggagaaggggcgugccaucuaucgaaggcgagggcagcgauagcaucuacgagaucaugaugcccaucuacgaagugaugaacauggaccuggaaacccggcggagcuucgcuguucagcagggccauuaccaggauccuagagccagcgacuacgaccugccuagagccuccgauuaugaucugccucggagccccuauccuacaccuccacugccaccuagauaccagcuccagaauauggacguggaagccggauuccgcgaggccguguaugcuagcuuuguggccggcauguacaacuacguggucacccagccucaagagcggauccccaauucucagcaggucgagggcauccugagggacaugcugaccaauggcgaccagaccuuccgggaccugaugaagagauggaacagagagguggaccgcgagcaccaccaccaucaccau

SEQ ID NO: 341 - RNA, 2436 nt, Artificial Sequence
  Synthetic Polynucleotide
auggaaaccccugcucagcugcuguuccugcugcugcuguggcugccugauaccacaggcaugagcccuauccucggcuacuggaagaucaaaggccuggugcagcccaccagacugcugcuggaauaccuggaagagaaguacgaggaacaccuguacgagcgcgacgagggcgauaaguggcggaacaagaaguucgagcugggccucgaguuccccaaccugccuuacuacaucgacggcgacgugaagcugacccagagcauggccaucauccgguauaucgccgacaagcacaacaugcucggcggcugcccuaaagagcgggccgagauuucuaugcuggaaggcgccgugcuggacaucagauacggcguguccagaaucgccuacagcaaggacuucgaaacccugaagguggacuuccugagcaagcugcccgagaugcugaagauguucgaggaccggcugugccacaagaccuaccugaauggcgaccacgugacacaccccgacuucaugcuguacgacgcccuggauguggugcuguacauggaccccaugugccuggacgccuuuccaaagcucgugugcuucaagaagcggaucgaggccauuccucagaucgacaaguaccugaaguccagcaaguauaucgcuuggccccugcaaggcuggcaggccacauuuggaggcggagaucacccuccuaagaugagcaucagaggcgucggcggcaacggcaacagcagaaucccuucucacaauggcgacggcagcaacaggcggagccagaauaccaagggcaacaacaagguggaagaucgcgugugcagccuguacagcuccagaagcaacgagaaccgcgagagcccuuaugccgugguggauguguccagcaugaucgagagcaccccuaccagcggcgagacaacaagagcuaguagaggcgugcugagccgguuucagagaggccucguucggauugccgacaaagugcggagagccgugcagugugcuuggagcaguguguccacaagcagaagcagcgccacaagagccgccgaaucuggcagcucuagcagaacagcuagaggcgccagcagcggcuacagagaguauucuccaucugccgccagaggccugcggcugauguuuacagauuucuggcggacccgggugcugagacagacaucuccuauggcuggcguguucggcaaccuggacgugaacgaagccagacugauggccgccuacacaagcgagugugccgaucaccuggaagccaaagaacuggccggaccugauggcguggcagccgcuagagaaaucgccaagagaugggagaagagagugcgggaccugcaggauaagggcgcugcuagaaagcugcugaacgacccucugggcagaagaaccccuaacuaccagagcaagaaccccggcgaguacaccgugggcaacuccauguucuacgacggaccccagguggccaaccugcagaauguggauacaggcuucuggcuggacaugcagcaccugucugaugugguccugagcagagagauccagaccggccugagagccagagccacacuggaagaguccaugccuaugcucgagaaucuggaagaacgguucagacggcugcaagagacaugcgacgccgccagaacagagaucgaggaaagcggcuggaccagagaaagcgccuccagaauggaaggcgacgaagcccaaggaccuagcagagugcagcaggccuuccagagcuucgugaacgagugcaacagcaucgaguucagcuucggcuccuucggcgaacaugugcgggugcugugugccagaguuagcagaggacuugcugccgcuggcgaggccaucagaagaugcuucucuugcugcaagggcagcacccacagauacgccccuagagaugaucugagcccugagggcgcaucucuggccgaaacacuggccagauuugccgacgacaugggcauugaaagaggcgccgacggaaccuacgacaucccucugguggacgauuggagaaggggcgugccaucuaucgaaggcgagggcagcgauagcaucuacgagaucaugaugcccaucuacgaagugaugaacauggaccuggaaacccggcggagcuuugccgugcaacagggccauuaccaggauccuagagccagcgacuacgaccugccuagagccuccgauuaugaucugccucggagccccuauccuacaccuccucugccuccaagauaccagcuucagaauauggacguggaagccggauuccgcgaggccguguaugcuagcuuuguggccggcauguacaacuacguggucacccagccucaagagagaauccccaacagccagcaggucgagggcauccugagagauaugcugaccaacggcgac

SEQ ID NO: 342 - RNA, 2454 nt, Artificial Sequence
  Synthetic Polynucleotide
auggaaaccccugcucagcugcuguuccugcugcugcuguggcugccugauaccacaggcaugagcccuauccucggcuacuggaagaucaaaggccuggugcagcccaccagacugcugcuggaauaccuggaagagaaguacgaggaacaccuguacgagcgcgacgagggcgauaaguggcggaacaagaaguucgagcugggccucgaguuccccaaccugccuuacuacaucgacggcgacgugaagcugacccagagcauggccaucauccgguauaucgccgacaagcacaacaugcucggcggcugcccuaaagagcgggccgagauuucuaugcuggaaggcgccgugcuggacaucagauacggcguguccagaaucgccuacagcaaggacuucgaaacccugaagguggacuuccugagcaagcugcccgagaugcugaagauguucgaggaccggcugugccacaagaccuaccugaauggcgaccacgugacacaccccgacuucaugcuguacgacgcccuggauguggugcuguacauggaccccaugugccuggacgccuuuccaaagcucgugugcuucaagaagcggaucgaggccauuccucagaucgacaaguaccugaaguccagcaaguauaucgcuuggccccugcaaggcuggcaggccacauuuggaggcggagaucacccuccuaagaugagcaucagaggcgucggcggcaacggcaacagcagaaucccuucucacaauggcgacggcagcaacaggcggagccagaauaccaagggcaacaacaagguggaagaucgcgugugcagccuguacagcuccagaagcaacgagaaccgcgagagcccuuaugccgugguggauguguccagcaugaucgagagcaccccuaccagcggcgagacaacaagagcuaguagaggcgugcugagccgguuucagagaggccucguucggauugccgacaaagugcggagagccgugcagugugcuuggagcaguguguccacaagcagaagcagcgccacaagagccgccgaaucuggcagcucuagcagaacagcuagaggcgccagcagcggcuacagagaguauucuccaucugccgccagaggccugcggcugauguuuacagauuucuggcggacccgggugcugagacagacaucuccuauggcuggcguguucggcaaccuggacgugaacgaagccagacugauggccgccuacacaagcgagugugccgaucaccuggaagccaaagaacuggccggaccugauggcguggcagccgcuagagaaaucgccaagagaugggagaagagagugcgggaccugcaggauaagggcgcugcuagaaagcugcugaacgacccucugggcagaagaaccccuaacuaccagagcaagaaccccggcgaguacaccgugggcaacuccauguucuacgacggaccccagguggccaaccugcagaauguggauacaggcuucuggcuggacaugcagcaccugucugaugugguccugagcagagagauccagaccggccugagagccagagccacacuggaagaguccaugccuaugcucgagaaucuggaagaacgguucagacggcugcaagagacaugcgacgccgccagaacagagaucgaggaaagcggcuggaccagagaaagcgccuccagaauggaaggcgacgaagcccaaggaccuagcagagugcagcaggccuuccagagcuucgugaacgagugcaacagcaucgaguucagcuucggcuccuucggcgaacaugugcgggugcugugugccagaguuagcagaggacuugcugccgcuggcgaggccaucagaagaugcuucucuugcugcaagggcagcacccacagauacgccccuagagaugaucugagcccugagggcgcaucucuggccgaaacacuggccagauuugccgacgacaugggcauugaaagaggcgccgacggaaccuacgacaucccucugguggacgauuggagaaggggcgugccaucuaucgaaggcgagggcagcgauagcaucuacgagaucaugaugcccaucuacgaagugaugaacauggaccuggaaacccggcggagcuuugccgugcaacagggccauuaccaggauccuagagccagcgacuacgaccugccuagagccuccgauuaugaucugccucggagccccuauccuacaccuccucugccuccaagauaccagcuucagaauauggacguggaagccggauuccgcgaggccguguaugcuagcuuuguggccggcauguacaacuacguggucacccagccucaagagagaauccccaacagccagcaggucgagggcauccugagagauaugcugaccaacggcgaccaccaccaucaccaucau

SEQ ID NO: 343 - RNA, 2487 nt, Artificial Sequence
  Synthetic Polynucleotide
auggaaaccccugcucagcugcuguuccugcugcugcuguggcugccugauaccacaggcaugagcccuauccucggcuacuggaagaucaaaggccuggugcagcccaccagacugcugcuggaauaccuggaagagaaguacgaggaacaccuguacgagcgcgacgagggcgauaaguggcggaacaagaaguucgagcugggccucgaguuccccaaccugccuuacuacaucgacggcgacgugaagcugacccagagcauggccaucauccgguauaucgccgacaagcacaacaugcucggcggcugcccuaaagagcgggccgagauuucuaugcuggaaggcgccgugcuggacaucagauacggcguguccagaaucgccuacagcaaggacuucgaaacccugaagguggacuuccugagcaagcugcccgagaugcugaagauguucgaggaccggcugugccacaagaccuaccugaauggcgaccacgugacacaccccgacuucaugcuguacgacgcccuggauguggugcuguacauggaccccaugugccuggacgccuuuccaaagcucgugugcuucaagaagcggaucgaggccauuccucagaucgacaaguaccugaaguccagcaaguauaucgcuuggccccugcaaggcuggcaggccacauuuggaggcggagaucacccuccuaagaugagcaucagaggcgucggcggcaacggcaacagcagaaucccuucucacaauggcgacggcagcaacaggcggagccagaauaccaagggcaacaacaagguggaagaucgcgugugcagccuguacagcuccagaagcaacgagaaccgcgagagcccuuaugccgugguggauguguccagcaugaucgagagcaccccuaccagcggcgagacaacaagagcuaguagaggcgugcugagccgguuucagagaggccucguucggauugccgacaaagugcggagagccgugcagugugcuuggagcaguguguccacaagcagaagcagcgccacaagagccgccgaaucuggcagcucuagcagaacagcuagaggcgccagcagcggcuacagagaguauucuccaucugccgccagaggccugcggcugauguuuacagauuucuggcggacccgggugcugagacagacaucuccuauggcuggcguguucggcaaccuggacgugaacgaagccagacugauggccgccuacacaagcgagugugccgaucaccuggaagccaaagaacuggccggaccugauggcguggcagccgcuagagaaaucgccaagagaugggagaagagagugcgggaccugcaggauaagggcgcugcuagaaagcugcugaacgacccucugggcagaagaaccccuaacuaccagagcaagaaccccggcgaguacaccgugggcaacuccauguucuacgacggaccccagguggccaaccugcagaauguggauacaggcuucuggcuggacaugcagcaccugucugaugugguccugagcagagagauccagaccggccugagagccagagccacacuggaagaguccaugccuaugcucgagaaucuggaagaacgguucagacggcugcaagagacaugcgacgccgccagaacagagaucgaggaaagcggcuggaccagagaaagcgccuccagaauggaaggcgacgaagcccaaggaccuagcagagugcagcaggccuuccagagcuucgugaacgagugcaacagcaucgaguucagcuucggcuccuucggcgaacaugugcgggugcugugugccagaguuagcagaggacuugcugccgcuggcgaggccaucagaagaugcuucucuugcugcaagggcagcacccacagauacgccccuagagaugaucugagcccugagggcgcaucucuggccgaaacacuggccagauuugccgacgacaugggcauugaaagaggcgccgacggaaccuacgacaucccucugguggacgauuggagaaggggcgugccaucuaucgaaggcgagggcagcgauagcaucuacgagaucaugaugcccaucuacgaagugaugaacauggaccuggaaacccggcggagcuuugccgugcaacagggccauuaccaggauccuagagccagcgacuacgaccugccuagagccuccgauuaugaucugccucggagccccuauccuacaccuccucugccuccaagauaccagcuucagaauauggacguggaagccggauuccgcgaggccguguaugcuagcuuuguggccggcauguacaacuacguggucacccagccucaagagagaauccccaacagccagcaggucgagggcauccugagagauaugcugaccaacggcgaccagaccuuccgcgaccugaugaagagauggaacagagagguggacagagag

SEQ ID NO: 344 - RNA, 2505 nt, Artificial Sequence
  Synthetic Polynucleotide
auggaaaccccugcucagcugcuguuccugcugcugcuguggcugccugauaccacaggcaugagcccuauccucggcuacuggaagaucaaaggccuggugcagcccaccagacugcugcuggaauaccuggaagagaaguacgaggaacaccuguacgagcgcgacgagggcgauaaguggcggaacaagaaguucgagcugggccucgaguuccccaaccugccuuacuacaucgacggcgacgugaagcugacccagagcauggccaucauccgguauaucgccgacaagcacaacaugcucggcggcugcccuaaagagcgggccgagauuucuaugcuggaaggcgccgugcuggacaucagauacggcguguccagaaucgccuacagcaaggacuucgaaacccugaagguggacuuccugagcaagcugcccgagaugcugaagauguucgaggaccggcugugccacaagaccuaccugaauggcgaccacgugacacaccccgacuucaugcuguacgacgcccuggauguggugcuguacauggaccccaugugccuggacgccuuuccaaagcucgugugcuucaagaagcggaucgaggccauuccucagaucgacaaguaccugaaguccagcaaguauaucgcuuggccccugcaaggcuggcaggccacauuuggaggcggagaucacccuccuaagaugagcaucagaggcgucggcggcaacggcaacagcagaaucccuucucacaauggcgacggcagcaacaggcggagccagaauaccaagggcaacaacaagguggaagaucgcgugugcagccuguacagcuccagaagcaacgagaaccgcgagagcccuuaugccgugguggauguguccagcaugaucgagagcaccccuaccagcggcgagacaacaagagcuaguagaggcgugcugagccgguuucagagaggccucguucggauugccgacaaagugcggagagccgugcagugugcuuggagcaguguguccacaagcagaagcagcgccacaagagccgccgaaucuggcagcucuagcagaacagcuagaggcgccagcagcggcuacagagaguauucuccaucugccgccagaggccugcggcugauguuuacagauuucuggcggacccgggugcugagacagacaucuccuauggcuggcguguucggcaaccuggacgugaacgaagccagacugauggccgccuacacaagcgagugugccgaucaccuggaagccaaagaacuggccggaccugauggcguggcagccgcuagagaaaucgccaagagaugggagaagagagugcgggaccugcaggauaagggcgcugcuagaaagcugcugaacgacccucugggcagaagaaccccuaacuaccagagcaagaaccccggcgaguacaccgugggcaacuccauguucuacgacggaccccagguggccaaccugcagaauguggauacaggcuucuggcuggacaugcagcaccugucugaugugguccugagcagagagauccagaccggccugagagccagagccacacuggaagaguccaugccuaugcucgagaaucuggaagaacgguucagacggcugcaagagacaugcgacgccgccagaacagagaucgaggaaagcggcuggaccagagaaagcgccuccagaauggaaggcgacgaagcccaaggaccuagcagagugcagcaggccuuccagagcuucgugaacgagugcaacagcaucgaguucagcuucggcuccuucggcgaacaugugcgggugcugugugccagaguuagcagaggacuugcugccgcuggcgaggccaucagaagaugcuucucuugcugcaagggcagcacccacagauacgccccuagagaugaucugagcccugagggcgcaucucuggccgaaacacuggccagauuugccgacgacaugggcauugaaagaggcgccgacggaaccuacgacaucccucugguggacgauuggagaaggggcgugccaucuaucgaaggcgagggcagcgauagcaucuacgagaucaugaugcccaucuacgaagugaugaacauggaccuggaaacccggcggagcuuugccgugcaacagggccauuaccaggauccuagagccagcgacuacgaccugccuagagccuccgauuaugaucugccucggagccccuauccuacaccuccucugccuccaagauaccagcuucagaauauggacguggaagccggauuccgcgaggccguguaugcuagcuuuguggccggcauguacaacuacguggucacccagccucaagagagaauccccaacagccagcaggucgagggcauccugagagauaugcugaccaacggcgaccagaccuuccgcgaccugaugaagagauggaacagagagguggacagagagcaccaccaccaucaccau

SEQ ID NO: 345 - RNA, 2088 nt, Artificial Sequence
  Synthetic Polynucleotide
auggaaaccccugcucagcugcuguuccugcugcugcuguggcugccugauaccacaggcaugagcccuauccucggcuacuggaagaucaaaggccuggugcagcccaccagacugcugcuggaauaccuggaagagaaguacgaggaacaccuguacgagcgcgacgagggcgauaaguggcggaacaagaaguucgagcugggccucgaguuccccaaccugccuuacuacaucgacggcgacgugaagcugacccagagcauggccaucauccgguauaucgccgacaagcacaacaugcucggcggcugcccuaaagagcgggccgagauuucuaugcuggaaggcgccgugcuggacaucagauacggcguguccagaaucgccuacagcaaggacuucgaaacccugaagguggacuuccugagcaagcugcccgagaugcugaagauguucgaggaccggcugugccacaagaccuaccugaauggcgaccacgugacacaccccgacuucaugcuguacgacgcccuggauguggugcuguacauggaccccaugugccuggacgccuuuccaaagcucgugugcuucaagaagcggaucgaggccauuccucagaucgacaaguaccugaaguccagcaaguauaucgcuuggccccugcaaggcuggcaggccacauuuggaggcggagaucacccuccuaagaugagcaucagaggcgucggcggcaacggcaacagcagaaucccuucucacaauggcgacggcagcaacaggcggagccagaauaccaagggcaacaacaagguggaagaucgcgugugcagccuguacagcuccagaagcaacgagaaccgcgagagcccuuaugccgugguggauguguccagcaugaucgagagcaccccuaccagcggcgagacaacaagagcuaguagaggcgugcugagccgguuucagagaggccucguucggauugccgacaaagugcggagagccgugcagugugcuuggagcaguguguccacaagcagaagcagcgccacaagagccgccgaaucuggcagcucuagcagaacagcuagaggcgccagcagcggcuacagagaguauucuccaucugccgccagaggccugcggcugauguuuacagauuucuggcggacccgggugcugagacagacaucuccuauggcuggcguguucggcaaccuggacgugaacgaagccagacugauggccgccuacacaagcgagugugccgaucaccuggaagccaaagaacuggccggaccugauggcguggcagccgcuagagaaaucgccaagagaugggagaagagagugcgggaccugcaggauaagggcgcugcuagaaagcugcugaacgacccucugggcagaagaaccccuaacuaccagagcaagaaccccggcgaguacaccgugggcaacuccauguucuacgacggaccccagguggccaaccugcagaauguggauacaggcuucuggcuggacaugcagcaccugucugaugugguccugagcagagagauccagaccggccugagagccagagccacacuggaagaguccaugccuaugcucgagaaucuggaagaacgguucagacggcugcaagagacaugcgacgccgccagaacagagaucgaggaaagcggcuggaccagagaaagcgccuccagaauggaaggcgacgaagcccaaggaccuagcagagugcagcaggccuuccagagcuucgugaacgagugcaacagcaucgaguucagcuucggcuccuucggcgaacaugugcgggugcugugugccagaguuagcagaggacuugcugccgcuggcgaggccaucagaagaugcuucucuugcugcaagggcagcacccacagauacgccccuagagaugaucugagcccugagggcgcaucucuggccgaaacacuggccagauuugccgacgacaugggcauugaaagaggcgccgacggaaccuacgacaucccucugguggacgauuggagaaggggcgugccaucuaucgaaggcgagggaucu

SEQ ID NO: 346 - RNA, 2106 nt, Artificial Sequence
  Synthetic Polynucleotide
auggaaaccccugcucagcugcuguuccugcugcugcuguggcugccugauaccacaggcaugagcccuauccucggcuacuggaagaucaaaggccuggugcagcccaccagacugcugcuggaauaccuggaagagaaguacgaggaacaccuguacgagcgcgacgagggcgauaaguggcggaacaagaaguucgagcugggccucgaguuccccaaccugccuuacuacaucgacggcgacgugaagcugacccagagcauggccaucauccgguauaucgccgacaagcacaacaugcucggcggcugcccuaaagagcgggccgagauuucuaugcuggaaggcgccgugcuggacaucagauacggcguguccagaaucgccuacagcaaggacuucgaaacccugaagguggacuuccugagcaagcugcccgagaugcugaagauguucgaggaccggcugugccacaagaccuaccugaauggcgaccacgugacacaccccgacuucaugcuguacgacgcccuggauguggugcuguacauggaccccaugugccuggacgccuuuccaaagcucgugugcuucaagaagcggaucgaggccauuccucagaucgacaaguaccugaaguccagcaaguauaucgcuuggccccugcaaggcuggcaggccacauuuggaggcggagaucacccuccuaagaugagcaucagaggcgucggcggcaacggcaacagcagaaucccuucucacaauggcgacggcagcaacaggcggagccagaauaccaagggcaacaacaagguggaagaucgcgugugcagccuguacagcuccagaagcaacgagaaccgcgagagcccuuaugccgugguggauguguccagcaugaucgagagcaccccuaccagcggcgagacaacaagagcuaguagaggcgugcugagccgguuucagagaggccucguucggauugccgacaaagugcggagagccgugcagugugcuuggagcaguguguccacaagcagaagcagcgccacaagagccgccgaaucuggcagcucuagcagaacagcuagaggcgccagcagcggcuacagagaguauucuccaucugccgccagaggccugcggcugauguuuacagauuucuggcggacccgggugcugagacagacaucuccuauggcuggcguguucggcaaccuggacgugaacgaagccagacugauggccgccuacacaagcgagugugccgaucaccuggaagccaaagaacuggccggaccugauggcguggcagccgcuagagaaaucgccaagagaugggagaagagagugcgggaccugcaggauaagggcgcugcuagaaagcugcugaacgacccucugggcagaagaaccccuaacuaccagagcaagaaccccggcgaguacaccgugggcaacuccauguucuacgacggaccccagguggccaaccugcagaauguggauacaggcuucuggcuggacaugcagcaccugucugaugugguccugagcagagagauccagaccggccugagagccagagccacacuggaagaguccaugccuaugcucgagaaucuggaagaacgguucagacggcugcaagagacaugcgacgccgccagaacagagaucgaggaaagcggcuggaccagagaaagcgccuccagaauggaaggcgacgaagcccaaggaccuagcagagugcagcaggccuuccagagcuucgugaacgagugcaacagcaucgaguucagcuucggcuccuucggcgaacaugugcgggugcugugugccagaguuagcagaggacuugcugccgcuggcgaggccaucagaagaugcuucucuugcugcaagggcagcacccacagauacgccccuagagaugaucugagcccugagggcgcaucucuggccgaaacacuggccagauuugccgacgacaugggcauugaaagaggcgccgacggaaccuacgacaucccucugguggacgauuggagaaggggcgugccaucuaucgaaggcgagggcucucaccaccaccaucaccau

SEQ ID NO: 347 - RNA, 1434 nt, Artificial Sequence
  Synthetic Polynucleotide
auggaaaccccugcucagcugcuguuccugcugcugcuguggcugccugauaccaccggcaugucuaucagaggcguuggcggcaacggcaacagcagaaucccuagccauaauggcgacggcagcaacaggcggagccagaauaccaagggcaacaacaagguggaagaucgcgugugcagccuguacagcuccagaagcaacgagaaccgcgagagcccuuaugccgugguggauguguccagcaugaucgagagcaccccuaccagcggcgagacaacaagagcuaguagaggcgugcugagccgguuucagagaggccucguucggaucgcugacaaagugcggagagccgugcagugugccuggucuaguguguccacaagcagaagcagcgccacaagagccgccgagagcggaucuucuagcagaacagcuagaggcgccagcagcggcuacagagaguauucuccaucugccgccagaggccugcggcugauguuuacagauuucuggcggacccgggugcugagacagacaucuccuauggcuggcguguucggcaaccuggaugugaaugaggccagacugauggccgccuacacaagcgaaugugccgaucaccuggaagccaaagagcuggcuggaccugacgguguugccgccgcuagagaaaucgccaagagaugggagaagagagugcgggaccugcaggauaagggcgcugcuagaaagcugcugaacgacccucugggcagaagaaccccuaacuaccagagcaagaaccccggcgaguacaccgugggcaacuccauguucuacgacggaccccagguggccaaccugcagaauguggauacaggcuucuggcuggauaugcagcaccugagcgacguggugcuguccagagagauccagacaggccugagagccagagccacacuggaagaguccaugccuaugcucgagaaccuggaagagagauuccggcggcugcaagagacaugugacgccgccagaaccgagaucgaggaaagcggcuggacaagagaaagcgccuccagaauggaaggcgacgaagcccaaggaccuagcagagugcagcaggccuuccagagcuucgugaacgagugcaacagcaucgaguucagcuucggcuccuucggcgaacaugugcgggugcugugugccagaguuagcagaggacuugcugccgcuggcgaggccaucagaagaugcuucucuugcugcaagggcagcacccacagauacgccccuagagaugaucugagcccugagggcgcuucucuggccgaaacacuggccagauucgccgacgauaugggcauugaaagaggcgccgacggaaccuacgacaucccucugguggacgauuggagaaggggcgugccaucuaucgaaggcgagggaucu

SEQ ID NO: 348 - RNA, 1452 nt, Artificial Sequence
  Synthetic Polynucleotide
auggaaaccccugcucagcugcuguuccugcugcugcuguggcugccugauaccaccggcaugucuaucagaggcguuggcggcaacggcaacagcagaaucccuagccauaauggcgacggcagcaacaggcggagccagaauaccaagggcaacaacaagguggaagaucgcgugugcagccuguacagcuccagaagcaacgagaaccgcgagagcccuuaugccgugguggauguguccagcaugaucgagagcaccccuaccagcggcgagacaacaagagcuaguagaggcgugcugagccgguuucagagaggccucguucggaucgcugacaaagugcggagagccgugcagugugccuggucuaguguguccacaagcagaagcagcgccacaagagccgccgagagcggaucuucuagcagaacagcuagaggcgccagcagcggcuacagagaguauucuccaucugccgccagaggccugcggcugauguuuacagauuucuggcggacccgggugcugagacagacaucuccuauggcuggcguguucggcaaccuggaugugaaugaggccagacugauggccgccuacacaagcgaaugugccgaucaccuggaagccaaagagcuggcuggaccugacgguguugccgccgcuagagaaaucgccaagagaugggagaagagagugcgggaccugcaggauaagggcgcugcuagaaagcugcugaacgacccucugggcagaagaaccccuaacuaccagagcaagaaccccggcgaguacaccgugggcaacuccauguucuacgacggaccccagguggccaaccugcagaauguggauacaggcuucuggcuggauaugcagcaccugagcgacguggugcuguccagagagauccagacaggccugagagccagagccacacuggaagaguccaugccuaugcucgagaaccuggaagagagauuccggcggcugcaagagacaugugacgccgccagaaccgagaucgaggaaagcggcuggacaagagaaagcgccuccagaauggaaggcgacgaagcccaaggaccuagcagagugcagcaggccuuccagagcuucgugaacgagugcaacagcaucgaguucagcuucggcuccuucggcgaacaugugcgggugcugugugccagaguuagcagaggacuugcugccgcuggcgaggccaucagaagaugcuucucuugcugcaagggcagcacccacagauacgccccuagagaugaucugagcccugagggcgcuucucuggccgaaacacuggccagauucgccgacgauaugggcauugaaagaggcgccgacggaaccuacgacaucccucugguggacgauuggagaaggggcgugccaucuaucgaaggcgagggcucucaccaccaccaucaccau

SEQ ID NO: 349 - RNA, 1782 nt, Artificial Sequence
  Synthetic Polynucleotide
auggaaaccccugcucagcugcuguuccugcugcugcuguggcugccugauaccaccggcaugucuaucagaggcguuggcggcaacggcaacagcagaaucccuagccauaauggcgacggcagcaacaggcggagccagaauaccaagggcaacaacaagguggaagaucgcgugugcagccuguacagcuccagaagcaacgagaaccgcgagagcccuuaugccgugguggauguguccagcaugaucgagagcaccccuaccagcggcgagacaacaagagcuaguagaggcgugcugagccgguuucagagaggccucguucggaucgcugacaaagugcggagagccgugcagugugccuggucuaguguguccacaagcagaagcagcgccacaagagccgccgagagcggaucuucuagcagaacagcuagaggcgccagcagcggcuacagagaguauucuccaucugccgccagaggccugcggcugauguuuacagauuucuggcggacccgggugcugagacagacaucuccuauggcuggcguguucggcaaccuggaugugaaugaggccagacugauggccgccuacacaagcgaaugugccgaucaccuggaagccaaagagcuggcuggaccugacgguguugccgccgcuagagaaaucgccaagagaugggagaagagagugcgggaccugcaggauaagggcgcugcuagaaagcugcugaacgacccucugggcagaagaaccccuaacuaccagagcaagaaccccggcgaguacaccgugggcaacuccauguucuacgacggaccccagguggccaaccugcagaauguggauacaggcuucuggcuggauaugcagcaccugagcgacguggugcuguccagagagauccagacaggccugagagccagagccacacuggaagaguccaugccuaugcucgagaaccuggaagagagauuccggcggcugcaagagacaugugacgccgccagaaccgagaucgaggaaagcggcuggacaagagaaagcgccuccagaauggaaggcgacgaagcccaaggaccuagcagagugcagcaggccuuccagagcuucgugaacgagugcaacagcaucgaguucagcuucggcuccuucggcgaacaugugcgggugcugugugccagaguuagcagaggacuugcugccgcuggcgaggccaucagaagaugcuucucuugcugcaagggcagcacccacagauacgccccuagagaugaucugagcccugagggcgcuucucuggccgaaacacuggccagauucgccgacgauaugggcauugaaagaggcgccgacggaaccuacgacaucccucugguggacgauuggagaaggggcgugccaucuaucgaaggcgagggcagcgauagcaucuacgagaucaugaugcccaucuacgaagugaugaacauggaccuggaaacccggcggagcuuugccgugcagcaaggccauuaccaggauccuagagccagcgacuacgaccugccuagagccuccgauuaugaucugccucggagccccuauccuacaccuccucugccuccaagauaccagcuucagaauauggacguggaagccggauuccgcgaggccguguaugcuagcuuuguggccggcauguacaacuacguggucacccagccucaagagagaauccccaacagccagcaggucgagggcauccugagagauaugcugaccaacggcgac

SEQ ID NO: 350 - RNA, 2436 nt, Artificial Sequence
  Synthetic Polynucleotide
auggaaaccccugcucagcugcuguuccugcugcugcuguggcugccugauaccacaggcaugagcccuauccucggcuacuggaagaucaaaggccuggugcagcccaccagacugcugcuggaauaccuggaagagaaguacgaggaacaccuguacgagcgcgacgagggcgauaaguggcggaacaagaaguucgagcugggccucgaguuccccaaccugccuuacuacaucgacggcgacgugaagcugacccagagcauggccaucauccgguauaucgccgacaagcacaacaugcucggcggcugcccuaaagagcgggccgagauuucuaugcuggaaggcgccgugcuggacaucagauacggcguguccagaaucgccuacagcaaggacuucgaaacccugaagguggacuuccugagcaagcugcccgagaugcugaagauguucgaggaccggcugugccacaagaccuaccugaauggcgaccacgugacacaccccgacuucaugcuguacgacgcccuggauguggugcuguacauggaccccaugugccuggacgccuuuccaaagcucgugugcuucaagaagcggaucgaggccauuccucagaucgacaaguaccugaaguccagcaaguauaucgcuuggccccugcaaggcuggcaggccacauuuggaggcggagaucacccuccuaagaugagcaucagaggcgucggcggcaacggcaacagcagaaucccuucucacaauggcgacggcagcaacaggcggagccagaauaccaagggcaacaacaagguggaagaucgcgugugcagccuguacagcuccagaagcaacgagaaccgcgagagcccuuaugccgugguggauguguccagcaugaucgagagcaccccuaccagcggcgagacaacaagagcuaguagaggcgugcugagccgguuucagagaggccucguucggauugccgacaaagugcggagagccgugcagugugcuuggagcaguguguccacaagcagaagcagcgccacaagagccgccgaaucuggcagcucuagcagaacagcuagaggcgccagcagcggcuacagagaguauucuccaucugccgccagaggccugcggcugauguuuacagauuucuggcggacccgggugcugagacagacaucuccuauggcuggcguguucggcaaccuggacgugaacgaagccagacugauggccgccuacacaagcgagugugccgaucaccuggaagccaaagaacuggccggaccugauggcguggcagccgcuagagaaaucgccaagagaugggagaagagagugcgggaccugcaggauaagggcgcugcuagaaagcugcugaacgacccucugggcagaagaaccccuaacuaccagagcaagaaccccggcgaguacaccgugggcaacuccauguucuacgacggaccccagguggccaaccugcagaauguggauacaggcuucuggcuggacaugagcaaccugagcgacgugguccugagcagagagauccagacaggccugagagccagagccacacuggaagaguccaugccuaugcucgagaaucuggaagaacgguucagacggcugcaagagacaugcgacgccgccagaacagagaucgaggaaagcggcuggaccagagaaagcgccuccagaauggaaggcgacgaagcccaaggaccuagcagagugcagcaggccuuccagagcuucgugaacgagugcaacagcaucgaguucagcuucggcuccuucggcgaacaugugcgggugcugugugccagaguuagcagaggacuugcugccgcuggcgaggccaucagaagaugcuucucuugcugcaagggcagcacccacagauacgccccuagagaugaucugagcccugagggcgcaucucuggccgaaacacuggccagauuugccgacgacaugggcauugaaagaggcgccgacggaaccuacgacaucccucugguggacgauuggagaaggggcgugccaucuaucgaaggcgagggcagcgauagcaucuacgagaucaugaugcccaucuacgaagugaugaacauggaccuggaaacccggcggagcuuugccgugcaacagggccauuaccaggauccuagagccagcgacuacgaccugccuagagccuccgauuaugaucugccucggagccccuauccuacaccuccucugccuccaagauaccagcuucagaauauggacguggaagccggauuccgcgaggccguguaugcuagcuuuguggccggcauguacaacuacguggucacccagccucaagagagaauccccaacagccagcaggucgagggcauccugagagauaugcugaccaacggcagc

SEQ ID NO: 351 - RNA, 2454 nt, Artificial Sequence
  Synthetic Polynucleotide
auggaaaccccugcucagcugcuguuccugcugcugcuguggcugccugauaccacaggcaugagcccuauccucggcuacuggaagaucaaaggccuggugcagcccaccagacugcugcuggaauaccuggaagagaaguacgaggaacaccuguacgagcgcgacgagggcgauaaguggcggaacaagaaguucgagcugggccucgaguuccccaaccugccuuacuacaucgacggcgacgugaagcugacccagagcauggccaucauccgguauaucgccgacaagcacaacaugcucggcggcugcccuaaagagcgggccgagauuucuaugcuggaaggcgccgugcuggacaucagauacggcguguccagaaucgccuacagcaaggacuucgaaacccugaagguggacuuccugagcaagcugcccgagaugcugaagauguucgaggaccggcugugccacaagaccuaccugaauggcgaccacgugacacaccccgacuucaugcuguacgacgcccuggauguggugcuguacauggaccccaugugccuggacgccuuuccaaagcucgugugcuucaagaagcggaucgaggccauuccucagaucgacaaguaccugaaguccagcaaguauaucgcuuggccccugcaaggcuggcaggccacauuuggaggcggagaucacccuccuaagaugagcaucagaggcgucggcggcaacggcaacagcagaaucccuucucacaauggcgacggcagcaacaggcggagccagaauaccaagggcaacaacaagguggaagaucgcgugugcagccuguacagcuccagaagcaacgagaaccgcgagagcccuuaugccgugguggauguguccagcaugaucgagagcaccccuaccagcggcgagacaacaagagcuaguagaggcgugcugagccgguuucagagaggccucguucggauugccgacaaagugcggagagccgugcagugugcuuggagcaguguguccacaagcagaagcagcgccacaagagccgccgaaucuggcagcucuagcagaacagcuagaggcgccagcagcggcuacagagaguauucuccaucugccgccagaggccugcggcugauguuuacagauuucuggcggacccgggugcugagacagacaucuccuauggcuggcguguucggcaaccuggacgugaacgaagccagacugauggccgccuacacaagcgagugugccgaucaccuggaagccaaagaacuggccggaccugauggcguggcagccgcuagagaaaucgccaagagaugggagaagagagugcgggaccugcaggauaagggcgcugcuagaaagcugcugaacgacccucugggcagaagaaccccuaacuaccagagcaagaaccccggcgaguacaccgugggcaacuccauguucuacgacggaccccagguggccaaccugcagaauguggauacaggcuucuggcuggacaugagcaaccugagcgacgugguccugagcagagagauccagacaggccugagagccagagccacacuggaagaguccaugccuaugcucgagaaucuggaagaacgguucagacggcugcaagagacaugcgacgccgccagaacagagaucgaggaaagcggcuggaccagagaaagcgccuccagaauggaaggcgacgaagcccaaggaccuagcagagugcagcaggccuuccagagcuucgugaacgagugcaacagcaucgaguucagcuucggcuccuucggcgaacaugugcgggugcugugugccagaguuagcagaggacuugcugccgcuggcgaggccaucagaagaugcuucucuugcugcaagggcagcacccacagauacgccccuagagaugaucugagcccugagggcgcaucucuggccgaaacacuggccagauuugccgacgacaugggcauugaaagaggcgccgacggaaccuacgacaucccucugguggacgauuggagaaggggcgugccaucuaucgaaggcgagggcagcgauagcaucuacgagaucaugaugcccaucuacgaagugaugaacauggaccuggaaacccggcggagcuuugccgugcaacagggccauuaccaggauccuagagccagcgacuacgaccugccuagagccuccgauuaugaucugccucggagccccuauccuacaccuccucugccuccaagauaccagcuucagaauauggacguggaagccggauuccgcgaggccguguaugcuagcuuuguggccggcauguacaacuacguggucacccagccucaagagagaauccccaacagccagcaggucgagggcauccugagagauaugcugaccaacggcagccaccaccaccaucaccau

SEQ ID NO: 352 - RNA, 2487 nt, Artificial Sequence
  Synthetic Polynucleotide
auggaaaccccugcucagcugcuguuccugcugcugcuguggcugccugauaccacaggcaugagcccuauccucggcuacuggaagaucaaaggccuggugcagcccaccagacugcugcuggaauaccuggaagagaaguacgaggaacaccuguacgagcgcgacgagggcgauaaguggcggaacaagaaguucgagcugggccucgaguuccccaaccugccuuacuacaucgacggcgacgugaagcugacccagagcauggccaucauccgguauaucgccgacaagcacaacaugcucggcggcugcccuaaagagcgggccgagauuucuaugcuggaaggcgccgugcuggacaucagauacggcguguccagaaucgccuacagcaaggacuucgaaacccugaagguggacuuccugagcaagcugcccgagaugcugaagauguucgaggaccggcugugccacaagaccuaccugaauggcgaccacgugacacaccccgacuucaugcuguacgacgcccuggauguggugcuguacauggaccccaugugccuggacgccuuuccaaagcucgugugcuucaagaagcggaucgaggccauuccucagaucgacaaguaccugaaguccagcaaguauaucgcuuggccccugcaaggcuggcaggccacauuuggaggcggagaucacccuccuaagaugagcaucagaggcgucggcggcaacggcaacagcagaaucccuucucacaauggcgacggcagcaacaggcggagccagaauaccaagggcaacaacaagguggaagaucgcgugugcagccuguacagcuccagaagcaacgagaaccgcgagagcccuuaugccgugguggauguguccagcaugaucgagagcaccccuaccagcggcgagacaacaagagcuaguagaggcgugcugagccgguuucagagaggccucguucggauugccgacaaagugcggagagccgugcagugugcuuggagcaguguguccacaagcagaagcagcgccacaagagccgccgaaucuggcagcucuagcagaacagcuagaggcgccagcagcggcuacagagaguauucuccaucugccgccagaggccugcggcugauguuuacagauuucuggcggacccgggugcugagacagacaucuccuauggcuggcguguucggcaaccuggacgugaacgaagccagacugauggccgccuacacaagcgagugugccgaucaccuggaagccaaagaacuggccggaccugauggcguggcagccgcuagagaaaucgccaagagaugggagaagagagugcgggaccugcaggauaagggcgcugcuagaaagcugcugaacgacccucugggcagaagaaccccuaacuaccagagcaagaaccccggcgaguacaccgugggcaacuccauguucuacgacggaccccagguggccaaccugcagaauguggauacaggcuucuggcuggacaugagcaaccugagcgacgugguccugagcagagagauccagacaggccugagagccagagccacacuggaagaguccaugccuaugcucgagaaucuggaagaacgguucagacggcugcaagagacaugcgacgccgccagaacagagaucgaggaaagcggcuggaccagagaaagcgccuccagaauggaaggcgacgaagcccaaggaccuagcagagugcagcaggccuuccagagcuucgugaacgagugcaacagcaucgaguucagcuucggcuccuucggcgaacaugugcgggugcugugugccagaguuagcagaggacuugcugccgcuggcgaggccaucagaagaugcuucucuugcugcaagggcagcacccacagauacgccccuagagaugaucugagcccugagggcgcaucucuggccgaaacacuggccagauuugccgacgacaugggcauugaaagaggcgccgacggaaccuacgacaucccucugguggacgauuggagaaggggcgugccaucuaucgaaggcgagggcagcgauagcaucuacgagaucaugaugcccaucuacgaagugaugaacauggaccuggaaacccggcggagcuuugccgugcaacagggccauuaccaggauccuagagccagcgacuacgaccugccuagagccuccgauuaugaucugccucggagccccuauccuacaccuccucugccuccaagauaccagcuucagaauauggacguggaagccggauuccgcgaggccguguaugcuagcuuuguggccggcauguacaacuacguggucacccagccucaagagagaauccccaacagccagcaggucgagggcauccugagagauaugcugaccaacggcagccagaccuuccgcgaccugaugaagagauggaacagagagguggacagagag

SEQ ID NO: 353 - RNA, 2505 nt, Artificial Sequence
  Synthetic Polynucleotide
auggaaaccccugcucagcugcuguuccugcugcugcuguggcugccugauaccacaggcaugagcccuauccucggcuacuggaagaucaaaggccuggugcagcccaccagacugcugcuggaauaccuggaagagaaguacgaggaacaccuguacgagcgcgacgagggcgauaaguggcggaacaagaaguucgagcugggccucgaguuccccaaccugccuuacuacaucgacggcgacgugaagcugacccagagcauggccaucauccgguauaucgccgacaagcacaacaugcucggcggcugcccuaaagagcgggccgagauuucuaugcuggaaggcgccgugcuggacaucagauacggcguguccagaaucgccuacagcaaggacuucgaaacccugaagguggacuuccugagcaagcugcccgagaugcugaagauguucgaggaccggcugugccacaagaccuaccugaauggcgaccacgugacacaccccgacuucaugcuguacgacgcccuggauguggugcuguacauggaccccaugugccuggacgccuuuccaaagcucgugugcuucaagaagcggaucgaggccauuccucagaucgacaaguaccugaaguccagcaaguauaucgcuuggccccugcaaggcuggcaggccacauuuggaggcggagaucacccuccuaagaugagcaucagaggcgucggcggcaacggcaacagcagaaucccuucucacaauggcgacggcagcaacaggcggagccagaauaccaagggcaacaacaagguggaagaucgcgugugcagccuguacagcuccagaagcaacgagaaccgcgagagcccuuaugccgugguggauguguccagcaugaucgagagcaccccuaccagcggcgagacaacaagagcuaguagaggcgugcugagccgguuucagagaggccucguucggauugccgacaaagugcggagagccgugcagugugcuuggagcaguguguccacaagcagaagcagcgccacaagagccgccgaaucuggcagcucuagcagaacagcuagaggcgccagcagcggcuacagagaguauucuccaucugccgccagaggccugcggcugauguuuacagauuucuggcggacccgggugcugagacagacaucuccuauggcuggcguguucggcaaccuggacgugaacgaagccagacugauggccgccuacacaagcgagugugccgaucaccuggaagccaaagaacuggccggaccugauggcguggcagccgcuagagaaaucgccaagagaugggagaagagagugcgggaccugcaggauaagggcgcugcuagaaagcugcugaacgacccucugggcagaagaaccccuaacuaccagagcaagaaccccggcgaguacaccgugggcaacuccauguucuacgacggaccccagguggccaaccugcagaauguggauacaggcuucuggcuggacaugagcaaccugagcgacgugguccugagcagagagauccagacaggccugagagccagagccacacuggaagaguccaugccuaugcucgagaaucuggaagaacgguucagacggcugcaagagacaugcgacgccgccagaacagagaucgaggaaagcggcuggaccagagaaagcgccuccagaauggaaggcgacgaagcccaaggaccuagcagagugcagcaggccuuccagagcuucgugaacgagugcaacagcaucgaguucagcuucggcuccuucggcgaacaugugcgggugcugugugccagaguuagcagaggacuugcugccgcuggcgaggccaucagaagaugcuucucuugcugcaagggcagcacccacagauacgccccuagagaugaucugagcccugagggcgcaucucuggccgaaacacuggccagauuugccgacgacaugggcauugaaagaggcgccgacggaaccuacgacaucccucugguggacgauuggagaaggggcgugccaucuaucgaaggcgagggcagcgauagcaucuacgagaucaugaugcccaucuacgaagugaugaacauggaccuggaaacccggcggagcuuugccgugcaacagggccauuaccaggauccuagagccagcgacuacgaccugccuagagccuccgauuaugaucugccucggagccccuauccuacaccuccucugccuccaagauaccagcuucagaauauggacguggaagccggauuccgcgaggccguguaugcuagcuuuguggccggcauguacaacuacguggucacccagccucaagagagaauccccaacagccagcaggucgagggcauccugagagauaugcugaccaacggcagccagaccuuccgcgaccugaugaagagauggaacagagagguggacagagagcaccaccaccaucaccau

SEQ ID NO: 354 - RNA, 2529 nt, Artificial Sequence
  Synthetic Polynucleotide
auggaaaccccugcucagcugcuguuccugcugcugcuguggcugccugauacaaccggcgagccuaagagcugcgacaagacccacaccuguccuccauguccugcuccagaacugcucggcggaccuuccguguuccuguuuccuccaaagccuaaggacacccugaugaucagcagaaccccugaagugaccugcguggugguggaugugucccacgaggaucccgaagugaaguucaauugguacguggacggcguggaagugcacaacgccaagaccaagccuagagaggaacaguacaacagcaccuacagagugguguccgugcugaccgugcugcaccaggauuggcugaacggcaaagaguacaagugcaagguguccaacaaggcccugccugcuccuaucgagaagaccaucagcaaggccaagggccagccaagagaaccccagguguacacacugccuccaagcagagaugagcugaccaagaaccaggugucccugaccugucuggucaagggcuucuaccccuccgauaucgccguggaaugggagagcaauggccagccugagaacaacuacaagacaaccccuccugugcuggacagcgacggcucauucuuccuguacagcaagcugacaguggacaagagcagauggcagcagggcaacguguucagcugcagcgugaugcacgaggcccugcacaaucacuacacccagaagucccugucucugagccccggcaagaugagcaucagaggcguuggcggcaacggcaacagcagaaucccuagccauaauggcgacggcagcaacaggcggagccagaauaccaagggcaacaacaagguggaagaucgcgugugcagccuguacuccagcagaagcaacgagaaccgcgagagcccuuaugccguggucgacguguccagcaugaucgagagcacaccuaccagcggcgagacaaccagagcuaguagaggcgugcugagccgguuucagagaggccucguucggaucgcugacaaagugcggagagccgugcagugugccuggucuaguguguccaccagcagauccucugccacaagagccgccgagucuggcagcucuagcagaacagcuagaggcgccagcagcggcuacagagaguauucuccaucugccgccagaggccugcggcugauguuuacagauuucuggcggacccgggugcugagacagacaucuccuauggcuggcguguucggcaaccuggaugugaaugaggccagacugauggccgccuacacaagcgaaugugccgaucaccuggaagccaaagagcuggcuggaccugacgguguugccgccgcuagagaaaucgccaagagaugggagaagagagugcgggaccugcaggauaagggcgcugcuagaaagcugcugaacgacccucugggcagaagaaccccuaacuaccagagcaagaaccccggcgaguacaccgugggcaacuccauguucuacgacggaccucagguggccaaccugcagaauguggauaccggcuucuggcuggauaugagcaaccugagcgacguggugcuguccagagagauccagacaggccugagagccagagccacacuggaagaguccaugccuaugcucgagaaccuggaagagagauuccggcggcugcaagagacaugugacgccgccagaaccgagaucgaggaaagcggcuggaccagagaaagcgccuccagaauggaaggcgacgaagcccaaggaccuagcagagugcagcaggccuuccagagcuucgugaacgagugcaacagcaucgaguucagcuucggcuccuucggcgaacaugugcgggugcugugugccagaguuagcagaggacuugcugccgcuggcgaggccaucagaagaugcuucucuugcugcaagggcagcacccacagauacgccccuagagaugaucugagcccugagggcgcaucucuggccgaaacacuggccagauucgccgacgauaugggcauugaaagaggcgccgacggaaccuacgacaucccucugguggacgauuggagaaggggcgugccaucuaucgaaggcgagggcagcgauagcaucuacgagaucaugaugcccaucuacgaagugaugaacauggaccuggaaacccggcggagcuucgcuguucagcagggccauuaccaggauccuagagccagcgacuacgaccugccuagagccuccgauuaugaucugccucggagccccuauccuacaccuccacugccaccuagauaccagcuccagaauauggacguggaagccggauuccgcgaggccguguaugcuagcuuuguggccggcauguacaacuacguggucacccagccucaagagcggauccccaauucucagcaggucgagggcauccugagggacaugcugacaaauggcagccagaccuuccgggaccugaugaagagauggaacagagagguggacagagag

SEQ ID NO: 355 - RNA, 2547 nt, Artificial Sequence
  Synthetic Polynucleotide
auggaaaccccugcucagcugcuguuccugcugcugcuguggcugccugauacaaccggcgagccuaagagcugcgacaagacccacaccuguccuccauguccugcuccagaacugcucggcggaccuuccguguuccuguuuccuccaaagccuaaggacacccugaugaucagcagaaccccugaagugaccugcguggugguggaugugucccacgaggaucccgaagugaaguucaauugguacguggacggcguggaagugcacaacgccaagaccaagccuagagaggaacaguacaacagcaccuacagagugguguccgugcugaccgugcugcaccaggauuggcugaacggcaaagaguacaagugcaagguguccaacaaggcccugccugcuccuaucgagaagaccaucagcaaggccaagggccagccaagagaaccccagguguacacacugccuccaagcagagaugagcugaccaagaaccaggugucccugaccugucuggucaagggcuucuaccccuccgauaucgccguggaaugggagagcaauggccagccugagaacaacuacaagacaaccccuccugugcuggacagcgacggcucauucuuccuguacagcaagcugacaguggacaagagcagauggcagcagggcaacguguucagcugcagcgugaugcacgaggcccugcacaaucacuacacccagaagucccugucucugagccccggcaagaugagcaucagaggcguuggcggcaacggcaacagcagaaucccuagccauaauggcgacggcagcaacaggcggagccagaauaccaagggcaacaacaagguggaagaucgcgugugcagccuguacuccagcagaagcaacgagaaccgcgagagcccuuaugccguggucgacguguccagcaugaucgagagcacaccuaccagcggcgagacaaccagagcuaguagaggcgugcugagccgguuucagagaggccucguucggaucgcugacaaagugcggagagccgugcagugugccuggucuaguguguccaccagcagauccucugccacaagagccgccgagucuggcagcucuagcagaacagcuagaggcgccagcagcggcuacagagaguauucuccaucugccgccagaggccugcggcugauguuuacagauuucuggcggacccgggugcugagacagacaucuccuauggcuggcguguucggcaaccuggaugugaaugaggccagacugauggccgccuacacaagcgaaugugccgaucaccuggaagccaaagagcuggcuggaccugacgguguugccgccgcuagagaaaucgccaagagaugggagaagagagugcgggaccugcaggauaagggcgcugcuagaaagcugcugaacgacccucugggcagaagaaccccuaacuaccagagcaagaaccccggcgaguacaccgugggcaacuccauguucuacgacggaccucagguggccaaccugcagaauguggauaccggcuucuggcuggauaugagcaaccugagcgacguggugcuguccagagagauccagacaggccugagagccagagccacacuggaagaguccaugccuaugcucgagaaccuggaagagagauuccggcggcugcaagagacaugugacgccgccagaaccgagaucgaggaaagcggcuggaccagagaaagcgccuccagaauggaaggcgacgaagcccaaggaccuagcagagugcagcaggccuuccagagcuucgugaacgagugcaacagcaucgaguucagcuucggcuccuucggcgaacaugugcgggugcugugugccagaguuagcagaggacuugcugccgcuggcgaggccaucagaagaugcuucucuugcugcaagggcagcacccacagauacgccccuagagaugaucugagcccugagggcgcaucucuggccgaaacacuggccagauucgccgacgauaugggcauugaaagaggcgccgacggaaccuacgacaucccucugguggacgauuggagaaggggcgugccaucuaucgaaggcgagggcagcgauagcaucuacgagaucaugaugcccaucuacgaagugaugaacauggaccuggaaacccggcggagcuucgcuguucagcagggccauuaccaggauccuagagccagcgacuacgaccugccuagagccuccgauuaugaucugccucggagccccuauccuacaccuccacugccaccuagauaccagcuccagaauauggacguggaagccggauuccgcgaggccguguaugcuagcuuuguggccggcauguacaacuacguggucacccagccucaagagcggauccccaauucucagcaggucgagggcauccugagggacaugcugacaaauggcagccagaccuuccgggaccugaugaagagauggaacagagagguggaccgcgagcaccaccaccaucaccau

SEQ ID NO: 356 - RNA, 561 nt, Artificial Sequence
  Synthetic Polynucleotide
auggaaaccccugcucagcugcuguuccugcugcugcuguggcugccugauaccaccggaaugagcagacagaacgccgaggagaaccugaagaacuucgccaaagagcugaagcugcccgacguggccuucgaccagaacaaugccugcauccuguucguggacggcgaguucucucugcaccugaccuacgaggaacacagcgaccggcuguauguguacgccccucugcuggauggccugccugacaacccucagagaaagcuggcccuguacgagaagcugcuggaaggcucuaugcucggcggacaaauggcugguggcggagugggaguugccaccaaagaacagcugauccugaugcacugcgugcuggacaugaaguacgccgagacuaaccugcugaaggcuuucgcccagcuguucaucgagacaguggucaaguggcggaccgugugcagcgauauuagcgccggcagagaacccaccguggacaccaugccucaaaugccacaaggcggcggaggcggaauucaaccuccuccagccggaauuagagcc

SEQ ID NO: 357 - RNA, 579 nt, Artificial Sequence
  Synthetic Polynucleotide
auggaaaccccugcucagcugcuguuccugcugcugcuguggcugccugauaccaccggaaugagcagacagaacgccgaggagaaccugaagaacuucgccaaagagcugaagcugcccgacguggccuucgaccagaacaaugccugcauccuguucguggacggcgaguucucucugcaccugaccuacgaggaacacagcgaccggcuguauguguacgccccucugcuggauggccugccugacaacccucagagaaagcuggcccuguacgagaagcugcuggaaggcucuaugcucggcggacaaauggcugguggcggagugggaguugccaccaaagaacagcugauccugaugcacugcgugcuggacaugaaguacgccgagacuaaccugcugaaggcuuucgcccagcuguucaucgagacaguggucaaguggcggaccgugugcagcgauauuagcgccggcagagaacccaccguggacaccaugccucaaaugccacaaggcggcggaggcggaauucaaccuccuccagccggaaucagagcccaccaccaucaccaucau

SEQ ID NO: 358 - RNA, 561 nt, Artificial Sequence
  Synthetic Polynucleotide
auggaaaccccugcucagcugcuguuccugcugcugcuguggcugccugauaccaccggaaugagcagacagaacgccgaggagaaccugaagaacuucgccaaagagcugaagcugcccgacguggccuucgaccagaacaauaccugcauccuguucguggacggcgaguucagccugcaccugaccuacgaggaacacagcgaccggcuguauguguacgccccucugcuggauggccugccugacaacccucagagaaagcuggcccuguacgagaagcugcuggaaggcucuaugcucggcggacaaauggcugguggcggagugggaguugccaccaaagaacagcugauccugaugcacugcgugcuggacaugaaguacgccgagacuaaccugcugaaggcuuucgcccagcuguucaucgagacaguggucaaguggcggaccgugugcagcgauauuagcgccggcagagaacccaccguggacaccaugccucaaaugccacaaggcggcggaggcggaauucaaccuccuccagccggaauuagagcc

SEQ ID NO: 359 - RNA, 579 nt, Artificial Sequence
  Synthetic Polynucleotide
auggaaaccccugcucagcugcuguuccugcugcugcuguggcugccugauaccaccggaaugagcagacagaacgccgaggagaaccugaagaacuucgccaaagagcugaagcugcccgacguggccuucgaccagaacaauaccugcauccuguucguggacggcgaguucagccugcaccugaccuacgaggaacacagcgaccggcuguauguguacgccccucugcuggauggccugccugacaacccucagagaaagcuggcccuguacgagaagcugcuggaaggcucuaugcucggcggacaaauggcugguggcggagugggaguugccaccaaagaacagcugauccugaugcacugcgugcuggacaugaaguacgccgagacuaaccugcugaaggcuuucgcccagcuguucaucgagacaguggucaaguggcggaccgugugcagcgauauuagcgccggcagagaacccaccguggacaccaugccucaaaugccacaaggcggcggaggcggaauucaaccuccuccagccggaaucagagcccaccaccaucaccaucau

SEQ ID NO: 360 - RNA, 3597 nt, Artificial Sequence
  Synthetic Polynucleotide
auggaaacuccugcccaacuguuguuccuucugcugcucugguugcccgacaccaccggaucgugcguggaucuccacgcuggcggccaguccgugaacgagcuuguguacgugggcccacaggccgugcuucugcuggaccagaucagagaucucuucguggguuccaaggacucccaggccgagggacaguaccggcucaucgucggcgacccuucaagcuuccaagagaaggaugccgacacucuuccggggaagguggaacaguccacucuguuuuccgugaccaacccagucguguuucaagggguggaccagcaggaccagguguccagccaaggacugaucuguucauucaccucgagcaauuuggacagcccccgggacggcgaaucguuccuuggcaucgcauucgugggagacucauccaaagcaggaaucacccuuaccgaugugaaggcgucccugagcggcgcugcucuguacuccaccgaagaucucaucuucgagaagaucaaggguggacuggaguucgccagcugcuccucacuggaacagggaggagccugugccgcccaaagcauccucauccacgauugccaggggcuccaagugaagcauuguaccacugccgugaacgccgagggaucauccgcuaacgaucaccucgguuucggagggggugccuucuucgugaccgguucgcugucgggagagaagucacuguauaugcccgcgggcgacaugguggucgccaacugcgauggagccaucucauucgagggaaacuccgccaacuucgcaaacggcggcgcuaucgccgcuagcgggaaggugcuguucguggcuaacgacaagaagacguccuucaucgagaaccgcgcccugucgggaggugccauugccgccagcuccgacauugccuuccagaacugugcggaacugguguucaaaggaaacugcgccaucggcaccgaagauaagggaagccugggaggcggcgccauuuccucccucggcaccgugcugcuucagggaaaccacggcaucacuugugacaagaacgaaagcgcgucccaggggggagcgaucuucgggaagaacugccagauuuccgacaacgagggaccggugguguucagagacuccacugccugccugggcggcggagcgaucgcagcacaggaaauugucagcauccagaacaaccaggccggcaucagcuucgaggggggaaaggcuucguucggcggagguauugccugcggaucguucucguccgcgggcggagccuccgugcucggaaccaucgacauuuccaagaaccugggcgcuaucucguuuucucgcacccugugcacuacuuccgaccugggucagauggaguaccagggaggcggagcgcuguuuggagagaacaucucucugagcgagaacgcgggagugcugaccuucaaggacaacauugugaagaccuucgccucaaacggaaagauccuggggggaggcgccauccuggcaaccgggaaggucgaaaucaccaacaauucagaggguaucuccuucacuggcaacgcccgggccccccaagcccugccgacucaggaagaguucccccuguucuccaagaaggaaggacgcccuuugucauccggcuacuccggugguggagcgauucugggucgggaaguggccauccugcauaaugcggccgugguguuugagcagaacagacuccaaugcuccgaagaagaggccacccuccuggggugcugcgggggcggagcagugcauggcauggauuccacuuccaucgugggaaacuccagcguccgcuucggaaacaacuacgcuaugggacagggagugucaggcggggcccugcuguccaagaccguccaguuggccggaaacgguucgguggauuucucacgcaauaucgccucgcugggaggcggcgcgcugcaggccuccgaaggaaauugcgaacuggucgacaacggcuacgugcuguuccgggacaaccgcggcaggguguacggcggagcaaucucgugccuucggggcgacgucgugaucucgggaaauaagggacgggucgaguuuaaggacaacaucgcuaccaggcucuacguggaggaaacuguggagaagguggaggaaguggagccugccccggaacagaaggacaacaacgagcugucguuccucggucgggcagaacaguccuucauuacugccgccaaccaggcccuguucgcguccgaagauggugaccucagcccggaauccagcaucuccuccgaggaacuggccaagcggagagaaugcgcgggaggcgcaaucuuugcgaagcggguccggaucguggacaaccaggaagcugugguguucagcaacaacuuuuccgacaucuacgguggugcaauuuucaccggcucacuccgggaggaggacaagcuggacggccagauucccgaggugcucauuuccggcaaugccggcgacgugguguucuccggaaacuccuccaagagggacgaacaccucccgcauaccggaggaggagccaucugcacucagaaccugacgaucucgcagaacaccggcaaugugcuguucuacaacaacgucgcauguuccgguggcgccgucagaaucgaggaccacggaaacgugcugcuggaagcauucgggggugauauuguguucaagggaaacagcagcuuccgggcccagggaucagaugcaaucuacuucgccgggaaggagagccacauuaccgcccugaacgccaccgagggucacgccaucguguuccacgaugcccugguguucgagaaccuggaggagcgcaagagcgccgaagugcugcuuaucaauucccgcgagaacccgggcuacaccggauccauccgguuccucgaagcggagucgaaggucccgcaguguauucaugugcaacaggggucccuggaacugcuuaacggagccacccugugcuccuacggcuuuaagcaggacgcgggcgcuaaacuggugcuggcggccggcgccaagcuuaagauccucgacuccggaaccccggugcagcaggggcacgcuauuagcaagccugaagccgagauugagucgucauccgaacccgaaggggcgcacucccuguggauagccaagaacgcgcagaccaccgugccaauggucgauauccacacaaucuccguggaccucgccagcuucucgucgagccagcaggagggaacugucgaagcgccucaggucaucgugccgggagguuccuacgugcgcucgggggagcucaaccuggaacucgugaauaccacuggaacgggauaugagaaccacgcccugcugaagaacgaagccaaagugccacugauguccuucgucgccuccggcgacgaggccuccgccgagauuagcaaccugucggugucagaucugcaaauucacguggugaccccugagauugaggaggacaccuacgggcacaugggcgauugguccgaggcgaagauccaggacggcacacuggucauuucauggaacccuaccggacaucaccaccaccaucac

SEQ ID NO: 361 - RNA, 3579 nt, Artificial Sequence
  Synthetic Polynucleotide
auggaaacuccugcccaacuguuguuccuucugcugcucugguugcccgacaccaccggaucgugcguggaucuccacgcuggcggccaguccgugaacgagcuuguguacgugggcccacaggccgugcuucugcuggaccagaucagagaucucuucguggguuccaaggacucccaggccgagggacaguaccggcucaucgucggcgacccuucaagcuuccaagagaaggaugccgacacucuuccggggaagguggaacaguccacucuguuuuccgugaccaacccagucguguuucaagggguggaccagcaggaccagguguccagccaaggacugaucuguucauucaccucgagcaauuuggacagcccccgggacggcgaaucguuccuuggcaucgcauucgugggagacucauccaaagcaggaaucacccuuaccgaugugaaggcgucccugagcggcgcugcucuguacuccaccgaagaucucaucuucgagaagaucaaggguggacuggaguucgccagcugcuccucacuggaacagggaggagccugugccgcccaaagcauccucauccacgauugccaggggcuccaagugaagcauuguaccacugccgugaacgccgagggaucauccgcuaacgaucaccucgguuucggagggggugccuucuucgugaccgguucgcugucgggagagaagucacuguauaugcccgcgggcgacaugguggucgccaacugcgauggagccaucucauucgagggaaacuccgccaacuucgcaaacggcggcgcuaucgccgcuagcgggaaggugcuguucguggcuaacgacaagaagacguccuucaucgagaaccgcgcccugucgggaggugccauugccgccagcuccgacauugccuuccagaacugugcggaacugguguucaaaggaaacugcgccaucggcaccgaagauaagggaagccugggaggcggcgccauuuccucccucggcaccgugcugcuucagggaaaccacggcaucacuugugacaagaacgaaagcgcgucccaggggggagcgaucuucgggaagaacugccagauuuccgacaacgagggaccggugguguucagagacuccacugccugccugggcggcggagcgaucgcagcacaggaaauugucagcauccagaacaaccaggccggcaucagcuucgaggggggaaaggcuucguucggcggagguauugccugcggaucguucucguccgcgggcggagccuccgugcucggaaccaucgacauuuccaagaaccugggcgcuaucucguuuucucgcacccugugcacuacuuccgaccugggucagauggaguaccagggaggcggagcgcuguuuggagagaacaucucucugagcgagaacgcgggagugcugaccuucaaggacaacauugugaagaccuucgccucaaacggaaagauccuggggggaggcgccauccuggcaaccgggaaggucgaaaucaccaacaauucagaggguaucuccuucacuggcaacgcccgggccccccaagcccugccgacucaggaagaguucccccuguucuccaagaaggaaggacgcccuuugucauccggcuacuccggugguggagcgauucugggucgggaaguggccauccugcauaaugcggccgugguguuugagcagaacagacuccaaugcuccgaagaagaggccacccuccuggggugcugcgggggcggagcagugcauggcauggauuccacuuccaucgugggaaacuccagcguccgcuucggaaacaacuacgcuaugggacagggagugucaggcggggcccugcuguccaagaccguccaguuggccggaaacgguucgguggauuucucacgcaauaucgccucgcugggaggcggcgcgcugcaggccuccgaaggaaauugcgaacuggucgacaacggcuacgugcuguuccgggacaaccgcggcaggguguacggcggagcaaucucgugccuucggggcgacgucgugaucucgggaaauaagggacgggucgaguuuaaggacaacaucgcuaccaggcucuacguggaggaaacuguggagaagguggaggaaguggagccugccccggaacagaaggacaacaacgagcugucguuccucggucgggcagaacaguccuucauuacugccgccaaccaggcccuguucgcguccgaagauggugaccucagcccggaauccagcaucuccuccgaggaacuggccaagcggagagaaugcgcgggaggcgcaaucuuugcgaagcggguccggaucguggacaaccaggaagcugugguguucagcaacaacuuuuccgacaucuacgguggugcaauuuucaccggcucacuccgggaggaggacaagcuggacggccagauucccgaggugcucauuuccggcaaugccggcgacgugguguucuccggaaacuccuccaagagggacgaacaccucccgcauaccggaggaggagccaucugcacucagaaccugacgaucucgcagaacaccggcaaugugcuguucuacaacaacgucgcauguuccgguggcgccgucagaaucgaggaccacggaaacgugcugcuggaagcauucgggggugauauuguguucaagggaaacagcagcuuccgggcccagggaucagaugcaaucuacuucgccgggaaggagagccacauuaccgcccugaacgccaccgagggucacgccaucguguuccacgaugcccugguguucgagaaccuggaggagcgcaagagcgccgaagugcugcuuaucaauucccgcgagaacccgggcuacaccggauccauccgguuccucgaagcggagucgaaggucccgcaguguauucaugugcaacaggggucccuggaacugcuuaacggagccacccugugcuccuacggcuuuaagcaggacgcgggcgcuaaacuggugcuggcggccggcgccaagcuuaagauccucgacuccggaaccccggugcagcaggggcacgcuauuagcaagccugaagccgagauugagucgucauccgaacccgaaggggcgcacucccuguggauagccaagaacgcgcagaccaccgugccaauggucgauauccacacaaucuccguggaccucgccagcuucucgucgagccagcaggagggaacugucgaagcgccucaggucaucgugccgggagguuccuacgugcgcucgggggagcucaaccuggaacucgugaauaccacuggaacgggauaugagaaccacgcccugcugaagaacgaagccaaagugccacugauguccuucgucgccuccggcgacgaggccuccgccgagauuagcaaccugucggugucagaucugcaaauucacguggugaccccugagauugaggaggacaccuacgggcacaugggcgauugguccgaggcgaagauccaggacggcacacuggucauuucauggaacccuaccgga

SEQ ID NO: 362 - RNA, 3579 nt, Artificial Sequence
  Synthetic Polynucleotide
auggaaacuccugcccaacuguuguuccuucugcugcucugguugcccgacaccaccggaucgugcguggaucuccacgcuggcggccaguccgugaacgagcuuguguacgugggcccacaggccgugcuucugcuggaccagaucagagaucucuucguggguuccaaggacucccaggccgagggacaguaccggcucaucgucggcgacccuucaagcuuccaagagaaggaugccgacacucuuccggggaagguggaacaguccacucuguuuuccgugaccaacccagucguguuucaagggguggaccagcaggaccagguguccagccaaggacugaucuguucauucaccucgagcaauuuggacagcccccgggacggcgaaucguuccuuggcaucgcauucgugggagacucauccaaagcaggaaucacccuuaccgaugugaaggcgucccugagcggcgcugcucuguacuccaccgaagaucucaucuucgagaagaucaaggguggacuggaguucgccagcugcuccucacuggaacagggaggagccugugccgcccaaagcauccucauccacgauugccaggggcuccaagugaagcauuguaccacugccgugaacgccgagggaucauccgcuaacgaucaccucgguuucggagggggugccuucuucgugaccgguucgcugucgggagagaagucacuguauaugcccgcgggcgacaugguggucgccaacugcgauggagccaucucauucgagggaaacuccgccaacuucgcaaacggcggcgcuaucgccgcuagcgggaaggugcuguucguggcuaacgacaagaagacguccuucaucgagaaccgcgcccugucgggaggugccauugccgccagcuccgacauugccuuccagaacugugcggaacugguguucaaaggaaacugcgccaucggcaccgaagauaagggaagccugggaggcggcgccauuuccucccucggcaccgugcugcuucagggaaaccacggcaucacuugugacaagaacgaagcagcgucccaggggggagcgaucuucgggaagaacugccagauuuccgacaacgagggaccggugguguucagagacuccacugccugccugggcggcggagcgaucgcagcacaggaaauugucagcauccagaacaaccaggccggcaucagcuucgaggggggaaaggcuucguucggcggagguauugccugcggaucguucucguccgcgggcggagccuccgugcucggaaccaucgacauuuccaagaaccugggcgcuaucucguuuucucgcacccugugcacuacuuccgaccugggucagauggaguaccagggaggcggagcgcuguuuggagagaacaucgcucugagcgagaacgcgggagugcugaccuucaaggacaacauugugaagaccuucgccucaaacggaaagauccuggggggaggcgccauccuggcaaccgggaaggucgaaaucaccaacaaugcagaggguaucuccuucacuggcaacgcccgggccccccaagcccugccgacucaggaagaguucccccuguucuccaagaaggaaggacgcccuuugucauccggcuacuccggugguggagcgauucugggucgggaaguggccauccugcauaaugcggccgugguguuugagcagaacagacuccaaugcuccgaagaagaggccacccuccuggggugcugcgggggcggagcagugcauggcauggauuccacuuccaucgugggaaacuccgcaguccgcuucggaaacaacuacgcuaugggacagggagugucaggcggggcccugcuguccaagaccguccaguuggccggaaacggugcgguggauuucucacgcaauaucgccucgcugggaggcggcgcgcugcaggccuccgaaggaaauugcgaacuggucgacaacggcuacgugcuguuccgggacaaccgcggcaggguguacggcggagcaaucucgugccuucggggcgacgucgugaucucgggaaauaagggacgggucgaguuuaaggacaacaucgcuaccaggcucuacguggaggaaacuguggagaagguggaggaaguggagccugccccggaacagaaggacaacaacgagcugucguuccucggucgggcagaacaguccuucauuacugccgccaaccaggcccuguucgcguccgaagauggugaccucagcccggaauccagcaucuccuccgaggaacuggccaagcggagagaaugcgcgggaggcgcaaucuuugcgaagcggguccggaucguggacaaccaggaagcugugguguucagcaacaacuuugccgacaucuacgguggugcaauuuucaccggcucacuccgggaggaggacaagcuggacggccagauucccgaggugcucauuuccggcaaugccggcgacgugguguucuccggaaacuccgccaagagggacgaacaccucccgcauaccggaggaggagccaucugcacucagaaccuggcaaucucgcagaacaccggcaaugugcuguucuacaacaacgucgcauguuccgguggcgccgucagaaucgaggaccacggaaacgugcugcuggaagcauucgggggugauauuguguucaagggaaacagcgcauuccgggcccagggaucagaugcaaucuacuucgccgggaaggagagccacauuaccgcccugaacgccgccgagggucacgccaucguguuccacgaugcccugguguucgagaaccuggaggagcgcaagagcgccgaagugcugcuuaucaauucccgcgagaacccgggcuacaccggauccauccgguuccucgaagcggagucgaaggucccgcaguguauucaugugcaacaggggucccuggaacugcuuaacggagccacccugugcuccuacggcuuuaagcaggacgcgggcgcuaaacuggugcuggcggccggcgccaagcuuaagauccucgacuccggaaccccggugcagcaggggcacgcuauuagcaagccugaagccgagauugagucgucauccgaacccgaaggggcgcacucccuguggauagccaagaacgcgcagaccaccgugccaauggucgauauccacacaaucuccguggaccucgccagcuucucgucgagccagcaggagggaacugucgaagcgccucaggucaucgugccgggagguuccuacgugcgcucgggggagcucaaccuggaacucgugaauaccgcuggaacgggauaugagaaccacgcccugcugaagaacgaagccaaagugccacugauguccuucgucgccuccggcgacgaggccuccgccgagauuagcaaccuggcggugucagaucugcaaauucacguggugaccccugagauugaggaggacaccuacgggcacaugggcgauugguccgaggcgaagauccaggacggcacacuggucauuucauggaacccugccgga

SEQ ID NO: 363 - RNA, 3597 nt, Artificial Sequence
  Synthetic Polynucleotide
auggaaacuccugcccaacuguuguuccuucugcugcucugguugcccgacaccaccggaucgugcguggaucuccacgcuggcggccaguccgugaacgagcuuguguacgugggcccacaggccgugcuucugcuggaccagaucagagaucucuucguggguuccaaggacucccaggccgagggacaguaccggcucaucgucggcgacccuucaagcuuccaagagaaggaugccgacacucuuccggggaagguggaacaguccacucuguuuuccgugaccaacccagucguguuucaagggguggaccagcaggaccagguguccagccaaggacugaucuguucauucaccucgagcaauuuggacagcccccgggacggcgaaucguuccuuggcaucgcauucgugggagacucauccaaagcaggaaucacccuuaccgaugugaaggcgucccugagcggcgcugcucuguacuccaccgaagaucucaucuucgagaagaucaaggguggacuggaguucgccagcugcuccucacuggaacagggaggagccugugccgcccaaagcauccucauccacgauugccaggggcuccaagugaagcauuguaccacugccgugaacgccgagggaucauccgcuaacgaucaccucgguuucggagggggugccuucuucgugaccgguucgcugucgggagagaagucacuguauaugcccgcgggcgacaugguggucgccaacugcgauggagccaucucauucgagggaaacuccgccaacuucgcaaacggcggcgcuaucgccgcuagcgggaaggugcuguucguggcuaacgacaagaagacguccuucaucgagaaccgcgcccugucgggaggugccauugccgccagcuccgacauugccuuccagaacugugcggaacugguguucaaaggaaacugcgccaucggcaccgaagauaagggaagccugggaggcggcgccauuuccucccucggcaccgugcugcuucagggaaaccacggcaucacuugugacaagaacgaagcagcgucccaggggggagcgaucuucgggaagaacugccagauuuccgacaacgagggaccggugguguucagagacuccacugccugccugggcggcggagcgaucgcagcacaggaaauugucagcauccagaacaaccaggccggcaucagcuucgaggggggaaaggcuucguucggcggagguauugccugcggaucguucucguccgcgggcggagccuccgugcucggaaccaucgacauuuccaagaaccugggcgcuaucucguuuucucgcacccugugcacuacuuccgaccugggucagauggaguaccagggaggcggagcgcuguuuggagagaacaucgcucugagcgagaacgcgggagugcugaccuucaaggacaacauugugaagaccuucgccucaaacggaaagauccuggggggaggcgccauccuggcaaccgggaaggucgaaaucaccaacaaugcagaggguaucuccuucacuggcaacgcccgggccccccaagcccugccgacucaggaagaguucccccuguucuccaagaaggaaggacgcccuuugucauccggcuacuccggugguggagcgauucugggucgggaaguggccauccugcauaaugcggccgugguguuugagcagaacagacuccaaugcuccgaagaagaggccacccuccuggggugcugcgggggcggagcagugcauggcauggauuccacuuccaucgugggaaacuccgcaguccgcuucggaaacaacuacgcuaugggacagggagugucaggcggggcccugcuguccaagaccguccaguuggccggaaacggugcgguggauuucucacgcaauaucgccucgcugggaggcggcgcgcugcaggccuccgaaggaaauugcgaacuggucgacaacggcuacgugcuguuccgggacaaccgcggcaggguguacggcggagcaaucucgugccuucggggcgacgucgugaucucgggaaauaagggacgggucgaguuuaaggacaacaucgcuaccaggcucuacguggaggaaacuguggagaagguggaggaaguggagccugccccggaacagaaggacaacaacgagcugucguuccucggucgggcagaacaguccuucauuacugccgccaaccaggcccuguucgcguccgaagauggugaccucagcccggaauccagcaucuccuccgaggaacuggccaagcggagagaaugcgcgggaggcgcaaucuuugcgaagcggguccggaucguggacaaccaggaagcugugguguucagcaacaacuuugccgacaucuacgguggugcaauuuucaccggcucacuccgggaggaggacaagcuggacggccagauucccgaggugcucauuuccggcaaugccggcgacgugguguucuccggaaacuccgccaagagggacgaacaccucccgcauaccggaggaggagccaucugcacucagaaccuggcaaucucgcagaacaccggcaaugugcuguucuacaacaacgucgcauguuccgguggcgccgucagaaucgaggaccacggaaacgugcugcuggaagcauucgggggugauauuguguucaagggaaacagcgcauuccgggcccagggaucagaugcaaucuacuucgccgggaaggagagccacauuaccgcccugaacgccgccgagggucacgccaucguguuccacgaugcccugguguucgagaaccuggaggagcgcaagagcgccgaagugcugcuuaucaauucccgcgagaacccgggcuacaccggauccauccgguuccucgaagcggagucgaaggucccgcaguguauucaugugcaacaggggucccuggaacugcuuaacggagccacccugugcuccuacggcuuuaagcaggacgcgggcgcuaaacuggugcuggcggccggcgccaagcuuaagauccucgacuccggaaccccggugcagcaggggcacgcuauuagcaagccugaagccgagauugagucgucauccgaacccgaaggggcgcacucccuguggauagccaagaacgcgcagaccaccgugccaauggucgauauccacacaaucuccguggaccucgccagcuucucgucgagccagcaggagggaacugucgaagcgccucaggucaucgugccgggagguuccuacgugcgcucgggggagcucaaccuggaacucgugaauaccgcuggaacgggauaugagaaccacgcccugcugaagaacgaagccaaagugccacugauguccuucgucgccuccggcgacgaggccuccgccgagauuagcaaccuggcggugucagaucugcaaauucacguggugaccccugagauugaggaggacaccuacgggcacaugggcgauugguccgaggcgaagauccaggacggcacacuggucauuucauggaacccugccggacaucaccaccaccaucac

SEQ ID NO: 364 - RNA, 2070 nt, Artificial Sequence
  Synthetic Polynucleotide
auggaaaccccugcucagcugcuguuccugcugcugcuguggcugccugauacaacaggcgccgagaucaugauuccccagggcaucuacgacggcgaaacccugaccgugucuuuccccuauaccgugaucggcgauccuagcggcaccaccguguuuucugcuggcgagcugacccugaagaaccuggacaacucuaucgccgcucugccccugagcugcuucggaaaucugcugggcagcuucaccgugcucggcagaggacacagccugaccuucgagaacauccggaccagcacaaauggcgcugcccugagcgauagcgccaauagcggccuguuuaccaucgagggcuucaaagagcugagcuucagcaacugcaacagccugcuggcagugcugccugccgccacaacaaauagcggcagccagacaccuaccaccaccagcacaccuucuaacggcgccaucuacagcaagaccgaccugcugcuccugaacaacgagaaguucagcuucuacuccaaccugguguccggcgacggcggagccauugaugccaaaucucugaccgugcagggcaucagcaagcugugcguguuccaagagaacacagcccaggcugauggcggagccugucagguggucacaagcuuuagcgccauggccaacgaggccccuaucgccuuuauugccaauguggccggcguuagaggcggaggaauugccgcuguucaggauggacagcagggcguguccagcagcacaagcacugaggauccugugguguccuucagcagaaacaccgccguggaauucgauggcaacguggccagaguuggcggcggaaucuacagcuacggaaacguggccuuucugaacaauggcaagacccuguuccucaacaacguggcaagccccguguauaucgccgccgagcagccuacaaauggccaggccucuaauaccgccgacaacuauggcgacgguggcgcaaucuucugcaagaauggugcucaggccgcuggcagcaacaaugccggcucuguguccuuugauggcgaaggcgugguguucuucuccucuaacguggccgcuggaaaaggcggcgcuaucuacgccaagaaacugagcguggccaacugcggcccugugcaguuucugggcaauaucgccaaugauggcggugccaucuaccugggagaguccggcgaacugucucugagcgccgauuacggcgacaucaucuucgacggcaaccugaagcggaccgccaaagaaaaugccgccgaugugaauggcgugacaguguccagccaggccaucucuaugggcucuggcggcaagaucaccacacugagagccaaggccggccaccagauccuguucaacgacccuaucgagauggccaauggcaacaaccagccugcucagagcagcgagccccugaagauuaacgauggcgagggcuacaccggcgauaucguguucgccaacggcaacagcgcccuguaccagaauguggccaucgagcagggcagaaucgugcugagagagaaggccaagcugagcgugaacagccugagucagacaggcggcagccuguauauggaagccggcagcacccuggacuucgugacaccucaaccuccacagcaaccuccagccgccaaccagcugaucacccugucuaaucugcaccugagccugaguucccugcuggccaacaacgccgugaccaauccuccuaccaauccaccagcucaggacucucacccugccaucaucggcucuacaacagccggaagcgugacaaucagcggccccaucuucuucgaggaccuggacgauaccgccuacgacagauacgauuggcugggcuccaaccagaaaaucgacgugcugaaacugcagcugggcacccagccaucugccaacgcuccaucugaucugacccugggcaacgagaugccuaaguacggcuaccaaggcagcuggaagcuggccugggauccuaacacagccaacaauggccccuacacacugaaggccaccuggaccaagacaggc

SEQ ID NO: 365 - RNA, 2088 nt, Artificial Sequence
  Synthetic Polynucleotide
auggaaaccccugcucagcugcuguuccugcugcugcuguggcugccugauacaacaggcgccgagaucaugauuccccagggcaucuacgacggcgaaacccugaccgugucuuuccccuauaccgugaucggcgauccuagcggcaccaccguguuuucugcuggcgagcugacccugaagaaccuggacaacucuaucgccgcucugccccugagcugcuucggaaaucugcugggcagcuucaccgugcucggcagaggacacagccugaccuucgagaacauccggaccagcacaaauggcgcugcccugagcgauagcgccaauagcggccuguuuaccaucgagggcuucaaagagcugagcuucagcaacugcaacagccugcuggcagugcugccugccgccacaacaaauagcggcagccagacaccuaccaccaccagcacaccuucuaacggcgccaucuacagcaagaccgaccugcugcuccugaacaacgagaaguucagcuucuacuccaaccugguguccggcgacggcggagccauugaugccaaaucucugaccgugcagggcaucagcaagcugugcguguuccaagagaacacagcccaggcugauggcggagccugucagguggucacaagcuuuagcgccauggccaacgaggccccuaucgccuuuauugccaauguggccggcguuagaggcggaggaauugccgcuguucaggauggacagcagggcguguccagcagcacaagcacugaggauccugugguguccuucagcagaaacaccgccguggaauucgauggcaacguggccagaguuggcggcggaaucuacagcuacggaaacguggccuuucugaacaauggcaagacccuguuccucaacaacguggcaagccccguguauaucgccgccgagcagccuacaaauggccaggccucuaauaccgccgacaacuauggcgacgguggcgcaaucuucugcaagaauggugcucaggccgcuggcagcaacaaugccggcucuguguccuuugauggcgaaggcgugguguucuucuccucuaacguggccgcuggaaaaggcggcgcuaucuacgccaagaaacugagcguggccaacugcggcccugugcaguuucugggcaauaucgccaaugauggcggugccaucuaccugggagaguccggcgaacugucucugagcgccgauuacggcgacaucaucuucgacggcaaccugaagcggaccgccaaagaaaaugccgccgaugugaauggcgugacaguguccagccaggccaucucuaugggcucuggcggcaagaucaccacacugagagccaaggccggccaccagauccuguucaacgacccuaucgagauggccaauggcaacaaccagccugcucagagcagcgagccccugaagauuaacgauggcgagggcuacaccggcgauaucguguucgccaacggcaacagcgcccuguaccagaauguggccaucgagcagggcagaaucgugcugagagagaaggccaagcugagcgugaacagccugagucagacaggcggcagccuguauauggaagccggcagcacccuggacuucgugacaccucaaccuccacagcaaccuccagccgccaaccagcugaucacccugucuaaucugcaccugagccugaguucccugcuggccaacaacgccgugaccaauccuccuaccaauccaccagcucaggacucucacccugccaucaucggcucuacaacagccggaagcgugacaaucagcggccccaucuucuucgaggaccuggacgauaccgccuacgacagauacgauuggcugggcuccaaccagaaaaucgacgugcugaaacugcagcugggcacccagccaucugccaacgcuccaucugaucugacccugggcaacgagaugccuaaguacggcuaccaaggcagcuggaagcuggccugggauccuaacacagccaacaauggccccuacacacugaaggccaccuggaccaagacaggccaccaccaucaccaucac

SEQ ID NO: 366 - RNA, 318 nt, Artificial Sequence
  Synthetic Polynucleotide
auggaaaccccugcucagcugcuguuccugcugcugcuguggcugccugauaccacaggcaugagccagaacaagaacagcgccuucaugcagcccgugaacguggcagcugaucuggccgcuauaguuggcgcuggcccuaugccuagaaccgagaucaucaagaagaugugggacuacauuaagaagaacggccugcaggaccccaccaacaagcggaacaucaaccccgacgacaagcuggccaagguguucggcacagagaagcccaucgacauguuccagaugaccaagauggugucccagcacaucaucaag

SEQ ID NO: 367 - RNA, 336 nt, Artificial Sequence
  Synthetic Polynucleotide
auggaaaccccugcucagcugcuguuccugcugcugcuguggcugccugauaccacaggcaugagccagaacaagaacagcgccuucaugcagcccgugaacguggcagcugaucuggccgcuauaguuggcgcuggcccuaugccuagaaccgagaucaucaagaagaugugggacuacauuaagaagaacggccugcaggaccccaccaacaagcggaacaucaaccccgacgacaagcuggccaagguguucggcacagagaagcccaucgacauguuccagaugaccaagauggugucccagcacaucaucaagcaccaccaccaucaccac

SEQ ID NO: 368 - RNA, 1833 nt, Artificial Sequence
  Synthetic Polynucleotide
auggaaaccccugcccagcugcuguuccugcugcugcuguggcugccugacaccaccggcaugagcaucagaggcgugggcggcaacggcaacagcagaaucccuagccacaacggcgacggcagcaacaggcggagccagaacaccaagggcaacaacaagguggaagauagagugugcagccuguacagcagccgguccaacgagaaccgcgagagcccuuaugccgugguggacguguccagcaugaucgagagcacccccaccagcggcgagacaaccagagcuaguagaggcgugcugagccgguuccagaggggccucgugcggauugcugacaaagugcggagagccgugcagugcgcuuggagcagcguguccacaagcagaagcagcgccacaagagccgccgagagcggcagcucuagcagaacagcuagaggcgccagcagcggcuacagagaguacagcccuucugccgcucggggccugcggcugauguucaccgacuuuuggcggacccgggugcugagacagaccucuccuauggccggcguguucggcaaccuggacgugaacgaggccagacugauggccgccuacaccagcgagugugccgaucaccuggaagccaaagagcuggccggaccugacggcguggcagccgcuagagaaaucgccaagagaugggagaagagagugcgggaccugcaggacaagggcgcugccagaaagcugcugaacgacccccugggcagacggacccccaacuaccagagcaagaaccccggcgaguacaccgugggcaacuccauguucuacgacggcccccagguggccaaccugcagaauguggauaccggcuucuggcuggacaugcagcaccugagcgacguggugcuguccagagagauccagaccggccugagagccagagccacccuggaagaguccaugcccaugcuggaaaaucuggaagagagauuccggcggcugcaggaaaccugcgacgccgccagaaccgagaucgaggaaagcggcuggacccgggaaagcgccuccagaauggaaggcgacgaagcccagggccccagcagagugcagcaggccuuucagagcuucgugaaugagugcaacagcaucgaguucagcuucggcuccuucggcgagcacgugcgggugcugugugccagagugucaagaggacuggccgcugccggcgaggccaucagaagaugcuucagcugcugcaagggcagcacccacagauacgcccccagagaugaccugucuccugagggcgccucucuggccgaaacccuggccagauucgccgacgacaugggcaucgaaagaggcgccgacggcaccuacgacaucccccugguggacgauuggagaaggggcgugccauccaucgagggcgagggcagcgauagcaucuacgagaucaugaugcccaucuacgaagugaugaacauggaccuggaaacccggcggagcuucgccgugcagcagggccauuaccaggaccccagagccagcgacuacgaccugccuagagccuccgauuacgaucugcccagaagccccuaccccaccccuccacugccucccagauaccagcugcagaacauggauguggaagccggcuuucgcgaggccguguacgccucuuuuguggccggcauguacaacuacgucgugacccagccccaggaacggauccccaauagccagcagguggaaggcauccugcgggacaugcugaccaacggcgaucagaccuuccgggaccugaugaagcgguggaacagagagguggaccgcgag

SEQ ID NO: 369 - RNA, 1851 nt, Artificial Sequence
  Synthetic Polynucleotide
auggaaaccccugcccagcugcuguuccugcugcugcuguggcugccugacaccaccggcaugagcaucagaggcgugggcggcaacggcaacagcagaaucccuagccacaacggcgacggcagcaacaggcggagccagaacaccaagggcaacaacaagguggaagauagagugugcagccuguacagcagccgguccaacgagaaccgcgagagcccuuaugccgugguggacguguccagcaugaucgagagcacccccaccagcggcgagacaaccagagcuaguagaggcgugcugagccgguuccagaggggccucgugcggauugcugacaaagugcggagagccgugcagugcgcuuggagcagcguguccacaagcagaagcagcgccacaagagccgccgagagcggcagcucuagcagaacagcuagaggcgccagcagcggcuacagagaguacagcccuucugccgcucggggccugcggcugauguucaccgacuuuuggcggacccgggugcugagacagaccucuccuauggccggcguguucggcaaccuggacgugaacgaggccagacugauggccgccuacaccagcgagugugccgaucaccuggaagccaaagagcuggccggaccugacggcguggcagccgcuagagaaaucgccaagagaugggagaagagagugcgggaccugcaggacaagggcgcugccagaaagcugcugaacgacccccugggcagacggacccccaacuaccagagcaagaaccccggcgaguacaccgugggcaacuccauguucuacgacggcccccagguggccaaccugcagaauguggauaccggcuucuggcuggacaugcagcaccugagcgacguggugcuguccagagagauccagaccggccugagagccagagccacccuggaagaguccaugcccaugcuggaaaaucuggaagagagauuccggcggcugcaggaaaccugcgacgccgccagaaccgagaucgaggaaagcggcuggacccgggaaagcgccuccagaauggaaggcgacgaagcccagggccccagcagagugcagcaggccuuucagagcuucgugaaugagugcaacagcaucgaguucagcuucggcuccuucggcgagcacgugcgggugcugugugccagagugucaagaggacuggccgcugccggcgaggccaucagaagaugcuucagcugcugcaagggcagcacccacagauacgcccccagagaugaccugucuccugagggcgccucucuggccgaaacccuggccagauucgccgacgacaugggcaucgaaagaggcgccgacggcaccuacgacaucccccugguggacgauuggagaaggggcgugccauccaucgagggcgagggcagcgauagcaucuacgagaucaugaugcccaucuacgaagugaugaacauggaccuggaaacccggcggagcuucgccgugcagcagggccauuaccaggaccccagagccagcgacuacgaccugccuagagccuccgauuacgaucugcccagaagccccuaccccaccccuccacugccucccagauaccagcugcagaacauggauguggaagccggcuuucgcgaggccguguacgccucuuuuguggccggcauguacaacuacgucgugacccagccccaggaacggauccccaauagccagcagguggaaggcauccugcgggacaugcugaccaacggcgaucagaccuuccgggaccugaugaagcgguggaacagagagguggaccgcgagcaccaccaucaccaccac

SEQ ID NO: 370 - RNA, 2019 nt, Artificial Sequence
  Synthetic Polynucleotide
auggaaaccccugcccaacugcuuuucuugcugcugcucuggcucccugacaccaccggaauggaaucuggacccgaguccgugucaagcaaccagaacuccaugaaccccaucauuaauggacagaucgcauccaauuccgaaaccaaggaaagcaccaaggcaucggaggccuccccauccgccucaagcuccgugucguccuggucguuucugucgagcgcgaagaaugcccugaucucacugcgggacgcgauucugaacaagaacagcuccccaaccgacucccugagccaacucgaggccucaacuuccacuucgacugugacuagggucgcugccaaggauuaugacgaggccaagagcaacuucgacaccgccaagagcggacuggaaaacgccaaaacccuggccgaauacgaaacuaagauggccgaucucauggcggcccugcaagacauggaacggcuggcgaacuccgauccguccaacaaccacacugaggaagugaacaacaucaagaaggcucucgaggcccagaaggauaccaucgacaaguugaacaagcuugugacgcugcagaaccaaaacaaggcccugacggaagugcucaaaaccaccgacucggccgaccagauuccggccaucaacagccagcuggagauuaacaagaacucggccgaucagauuaucaaggaccuggagcgccagaacauuaacuacgaggccgucuugacuaacgccggcgaagugaucaaggcgucauccgaagccggcauuaagcugggacaggcgcugcaauccaucgucgacgccggcgaccagucccaggcggcggugcugcaggcccagcagaacaacucccccgauaacaucgcugcaaccaaggaacugauugacgcggccgaaaccaaagucaacgaacugaagcaggagcacacuggucugaccgacucgccgcucgugaagaaggccgaagaacagaucagccaggcucagaaggauauccaggaaaucaagccuucggggagcgacaucccgaucgugggaccguccgguuccgccgcuuccgccggguccgcagccggggcccuuaagucgucgaacaauagcggcagaauaucccugcugcucgacgauguggauaacgagauggccgccauugcgcugcaaggauuccgguccaugaucgagcaguucaacgugaacaaccccgccaccgccaaggagcugcaggcuauggaggcccaacucacugccauguccgaccagcucgugggagcggacggagaacugccagccgagauccaggccaucaaggacgcucuggcccaggcacugaagcagccguccgcggauggccuggccaccgccaugggccaggucgcguucgccgccgcuaaagucggcggagguucggccggcacugccgggaccgugcagaugaaugucaagcagcuguacaagacugcguucucgucgaccagcuccagcuccuacgccgcggcccuguccgacgguuacagcgcguacaagacccugaacucccuuuacuccgaaucgagauccgggguccaguccgcaauuucacaaaccgccaauccugcccugucgcgcucagugucacgcagcggcaucgagucacagggcagaagcgccgacgcuagccaaagggccgcagaaaccauugugcgggacucccagacacuuggagaugucuacagccgccuccaagugcuggacucccucauguccaccaucgugucaaacccucaggcuaaccaggaggaaaucaugcagaagcugaccgcaagcauuuccaaggcuccgcaguuuggauaccccgcugugcaaaacuccgcggacagcuugcagaaauucgcagcccaguuggagagggaguucguggacggggagcggucccucgcggagucccaggagaacgcauuccggaagcagcccgccuucauucaacaagugcuugugaacaucgccucccuguucuccgguuaccugucu

SEQ ID NO: 371 - RNA, 2037 nt, Artificial Sequence
  Synthetic Polynucleotide
auggaaaccccugcccaacugcuuuucuugcugcugcucuggcucccugacaccaccggaauggaaucuggacccgaguccgugucaagcaaccagaacuccaugaaccccaucauuaauggacagaucgcauccaauuccgaaaccaaggaaagcaccaaggcaucggaggccuccccauccgccucaagcuccgugucguccuggucguuucugucgagcgcgaagaaugcccugaucucacugcgggacgcgauucugaacaagaacagcuccccaaccgacucccugagccaacucgaggccucaacuuccacuucgacugugacuagggucgcugccaaggauuaugacgaggccaagagcaacuucgacaccgccaagagcggacuggaaaacgccaaaacccuggccgaauacgaaacuaagauggccgaucucauggcggcccugcaagacauggaacggcuggcgaacuccgauccguccaacaaccacacugaggaagugaacaacaucaagaaggcucucgaggcccagaaggauaccaucgacaaguugaacaagcuugugacgcugcagaaccaaaacaaggcccugacggaagugcucaaaaccaccgacucggccgaccagauuccggccaucaacagccagcuggagauuaacaagaacucggccgaucagauuaucaaggaccuggagcgccagaacauuaacuacgaggccgucuugacuaacgccggcgaagugaucaaggcgucauccgaagccggcauuaagcugggacaggcgcugcaauccaucgucgacgccggcgaccagucccaggcggcggugcugcaggcccagcagaacaacucccccgauaacaucgcugcaaccaaggaacugauugacgcggccgaaaccaaagucaacgaacugaagcaggagcacacuggucugaccgacucgccgcucgugaagaaggccgaagaacagaucagccaggcucagaaggauauccaggaaaucaagccuucggggagcgacaucccgaucgugggaccguccgguuccgccgcuuccgccggguccgcagccggggcccuuaagucgucgaacaauagcggcagaauaucccugcugcucgacgauguggauaacgagauggccgccauugcgcugcaaggauuccgguccaugaucgagcaguucaacgugaacaaccccgccaccgccaaggagcugcaggcuauggaggcccaacucacugccauguccgaccagcucgugggagcggacggagaacugccagccgagauccaggccaucaaggacgcucuggcccaggcacugaagcagccguccgcggauggccuggccaccgccaugggccaggucgcguucgccgccgcuaaagucggcggagguucggccggcacugccgggaccgugcagaugaaugucaagcagcuguacaagacugcguucucgucgaccagcuccagcuccuacgccgcggcccuguccgacgguuacagcgcguacaagacccugaacucccuuuacuccgaaucgagauccgggguccaguccgcaauuucacaaaccgccaauccugcccugucgcgcucagugucacgcagcggcaucgagucacagggcagaagcgccgacgcuagccaaagggccgcagaaaccauugugcgggacucccagacacuuggagaugucuacagccgccuccaagugcuggacucccucauguccaccaucgugucaaacccucaggcuaaccaggaggaaaucaugcagaagcugaccgcaagcauuuccaaggcuccgcaguuuggauaccccgcugugcaaaacuccgcggacagcuugcagaaauucgcagcccaguuggagagggaguucguggacggggagcggucccucgcggagucccaggagaacgcauuccggaagcagcccgccuucauucaacaagugcuugugaacaucgccucccuguucuccgguuaccugucucaucaccaccaccaucac

SEQ ID NO: 372 - RNA, 408 nt, Artificial Sequence
  Synthetic Polynucleotide
auggaaaccccugcccagcugcuguuccugcugcugcuguggcugccugauaccaccggcccuagcagcacccaggacaacagauccauggaccagcaggacagcgaggaauuucugcugcagaacacccuggaagauagcgagaucaucagcauccccgacaccaugaaccagaucgccaucgacaccgagaagugguucuaccugaacaaggacugcaccaacgugggccccaucuccaucgugcagcugaccgccuuccugaaagagugcaagcacagccccgagaagggcaucgacccccaggaacuguggguguggaagaaaggcaugcccaacugggagaaagugaagaacauccccgagcugagcggcaccgugaaggacgagcaccaccaccaucaccac

SEQ ID NO: 373 - RNA, 390 nt, Artificial Sequence
  Synthetic Polynucleotide
auggaaaccccugcccagcugcuguuccugcugcugcuguggcugccugauaccaccggcccuagcagcacccaggacaacagauccauggaccagcaggacagcgaggaauuucugcugcagaacacccuggaagauagcgagaucaucagcauccccgacaccaugaaccagaucgccaucgacaccgagaagugguucuaccugaacaaggacugcaccaacgugggccccaucuccaucgugcagcugaccgccuuccugaaagagugcaagcacagccccgagaagggcaucgacccccaggaacuguggguguggaagaaaggcaugcccaacugggagaaagugaagaacauccccgagcugagcggcaccgugaaggacgaa

SEQ ID NO: 374 - RNA, 516 nt, Artificial Sequence
  Synthetic Polynucleotide
augaacagcgggauguuccccuucaccuucuuucugcuguacaucugccugggcaugcugaccgccuaccuggccaacaagaagaaccggaaccugaucggcugguuccuggccggcauguucuucggaaucuucgccaucauuuuucugcugauccugcccccccugcccagcagcacacaggacaacagauccauggaccagcaggacagcgaagaguuccugcugcagaacacccuggaagauagcgagaucaucagcauccccgacaccaugaaccagaucgccaucgacaccgagaagugguucuaccugaacaaggacugcaccaacgugggccccaucuccaucgugcagcugacagccuuccugaaagagugcaagcacagccccgagaagggcaucgacccccaggaacuguggguguggaagaaaggcaugcccaacugggagaaagugaagaacauccccgagcugagcggcaccgugaaggacgagcaccaccaccaucaccac

SEQ ID NO: 375 - RNA, 498 nt, Artificial Sequence
  Synthetic Polynucleotide
augaacagcgggauguuccccuucaccuucuuucugcuguacaucugccugggcaugcugaccgccuaccuggccaacaagaagaaccggaaccugaucggcugguuccuggccggcauguucuucggaaucuucgccaucauuuuucugcugauccugcccccccugcccagcagcacacaggacaacagauccauggaccagcaggacagcgaagaguuccugcugcagaacacccuggaagauagcgagaucaucagcauccccgacaccaugaaccagaucgccaucgacaccgagaagugguucuaccugaacaaggacugcaccaacgugggccccaucuccaucgugcagcugacagccuuccugaaagagugcaagcacagccccgagaagggcaucgacccccaggaacuguggguguggaagaaaggcaugcccaacugggagaaagugaagaacauccccgagcugagcggcaccgugaaggacgaa

SEQ ID NO: 376 - RNA, 1653 nt, Artificial Sequence
  Synthetic Polynucleotide
auggaaaccccugcccagcugcuguuccugcuccugcuguggcugccugauaccacaggcagcggcgugcuggaaaccagcauggccgagagccugagcaccaacgugaucagccuggccgacaccaaggccaaggacaacaccagccacaagagcaagaaggcccggaagaaccacagcaaagaaacccugguggaccggaaagagguggccccugugcacgagucuaaggccacaggccccaagcaggacagcugcuucggccggauguacaccgugaaagugaacgacgaccggaacguggaaaucacccaggccgugccugaguacgccacagugggcagcccuuaccccaucgagaucaccgccaccggcaagagggauugcguggaugugaucauuacccaacagcugccuugcgaggccgaguucgugcgcucugauccugccaccaccccuaccgccgauggcaagcucguguggaagaucgacagacugggccagggcgagaaguccaaaaucacugugugggucaagccccugaaagaggggugcugcuuuaccgcagccaccgugugugccugccccgagauuagaagcgugaccaaguguggccagcccgccaucugcgugaagcaggaaggaccugagaacgccugccugagaugccccgugguguacaagaucaacgucgugaaccagggcaccgccauugccagaaacguggugguggaaaaccccgugcccgacggcuacgcccacagcucuggacagagagugcugaccuucacccugggcgacaugcagcccggcgagcacagaaccaucaccguggaauucugcccccugaagcggggcagagccaccaacauugcgacaguguccuacuguggcgggcacaagaacaccgccuccgugaccaccgugaucaacgagccuugcgugcagguguccauugccggcgcugacugguccuacgugugcaagccaguggaguacgugaucuccguguccaaccccggcgaccuggugcugagagauguggugguugaggauacccugagcccuggcgugacaguccuggaagcugcuggcgcccagaucagcugcaacaaggugguguggacagugaaagagcugaaccccggggagucccugcaguacaaggugcucgugcgggcccagaccccuggccaguucaccaacaauguggucgugaaguccugcagcgacugcggcaccuguaccucuugugccgaggccaccacguacuggaaaggcguggccgcuacccauaugugcgugguggauaccugcgaccccgucugcgugggcgaaaacaccguguaccggaucugugugaccaaccggggcagcgccgaggacaccaaugugucccugaugcugaaguucuccaaagaacugcaacccgugagcuucagcggccccaccaagggaacaaucacuggcaacaccgucguuuucgacagccugccucggcugggcucuaaggaaacuguggaguucagcgugacacugaaggccgugucugccggggaugcuagaggcgaggccauccugagcagcgacacacugacggucccuguguccgacaccgagaauacccacaucuaccaccaccaucaucaccau

SEQ ID NO: 377 - RNA, 1635 nt, Artificial Sequence
  Synthetic Polynucleotide
auggaaaccccugcccagcugcuguuccugcuccugcuguggcugccugauaccacaggcagcggcgugcuggaaaccagcauggccgagagccugagcaccaacgugaucagccuggccgacaccaaggccaaggacaacaccagccacaagagcaagaaggcccggaagaaccacagcaaagaaacccugguggaccggaaagagguggccccugugcacgagucuaaggccacaggccccaagcaggacagcugcuucggccggauguacaccgugaaagugaacgacgaccggaacguggaaaucacccaggccgugccugaguacgccacagugggcagcccuuaccccaucgagaucaccgccaccggcaagagggauugcguggaugugaucauuacccaacagcugccuugcgaggccgaguucgugcgcucugauccugccaccaccccuaccgccgauggcaagcucguguggaagaucgacagacugggccagggcgagaaguccaaaaucacugugugggucaagccccugaaagaggggugcugcuuuaccgcagccaccgugugugccugccccgagauuagaagcgugaccaaguguggccagcccgccaucugcgugaagcaggaaggaccugagaacgccugccugagaugccccgugguguacaagaucaacgucgugaaccagggcaccgccauugccagaaacguggugguggaaaaccccgugcccgacggcuacgcccacagcucuggacagagagugcugaccuucacccugggcgacaugcagcccggcgagcacagaaccaucaccguggaauucugcccccugaagcggggcagagccaccaacauugcgacaguguccuacuguggcgggcacaagaacaccgccuccgugaccaccgugaucaacgagccuugcgugcagguguccauugccggcgcugacugguccuacgugugcaagccaguggaguacgugaucuccguguccaaccccggcgaccuggugcugagagauguggugguugaggauacccugagcccuggcgugacaguccuggaagcugcuggcgcccagaucagcugcaacaaggugguguggacagugaaagagcugaaccccggggagucccugcaguacaaggugcucgugcgggcccagaccccuggccaguucaccaacaauguggucgugaaguccugcagcgacugcggcaccuguaccucuugugccgaggccaccacguacuggaaaggcguggccgcuacccauaugugcgugguggauaccugcgaccccgucugcgugggcgaaaacaccguguaccggaucugugugaccaaccggggcagcgccgaggacaccaaugugucccugaugcugaaguucuccaaagaacugcaacccgugagcuucagcggccccaccaagggaacaaucacuggcaacaccgucguuuucgacagccugccucggcugggcucuaaggaaacuguggaguucagcgugacacugaaggccgugucugccggggaugcuagaggcgaggccauccugagcagcgacacacugacggucccuguguccgacaccgagaauacccacaucuac

SEQ ID NO: 378 - RNA, 1833 nt, Artificial Sequence
  Synthetic Polynucleotide
auggaaacucccgcacaguuacuuuucuuguugcuucuauggcuccccgauaccaccgggaugagcaucagaggcgucggcgggaacggcaacagcagaauucccucccacaacggcgacggcagcaacagaagaucccagaacacaaagggcaauaauaaggucgaggacagagugugcagccucuacuccagcaggucuaacgagaauagggaguccccguacgccguugucgacgugaguucuaugauagagagcacgcccacguccggagaaacaacuagagcaagcaggggcguccugagccgguuccagagaggucuggugcgaauugccgacaaggugagacgggcagugcaaugcgccuggagcagcgucuccaccagcagaagcagcgccacccgcgcugccgaaucaggcagcagcuccagaacggcacggggcgccuccuccggcuaccgagaguacuccccuagcgccgccagaggccugagacugauguucaccgauuuuuggaggacacggguucugagacagaccucccccauggcugggguguucggcaaccuggacgucaaugaagccagacucauggccgcauauacuucugagugcgcugaccaccuggaagcuaaggaacuggcgggccccgauggcguggccgcggcccgggagaucgccaagagaugggagaagagagugcgggaccugcaagacaagggggccgcccggaagcugcugaacgaucccuugggccgccggacaccgaacuaucagagcaagaacccgggcgaguacaccgugggaaacagcauguucuaugacggaccucagguggcaaaccugcagaacguggacacuggauuuuggcucgacaugaguaaccucuccgaugucguucugucucgugagauacagacaggucugcgggcuagagccacccuugaggagagcaugccuauguuggagaaucuggaggagcgguucagaagacugcaggagacuugcgaugccgccaggaccgagauugaggagagcggcuggacccgggaaagcgccucaaggauggagggagacgaggcccagggacccuccaggguucagcaggccuuccagucguucgugaaugaaugcaacagcaucgaguucagcuucggaagcuucggagagcacgugcgagugcugugcgccagaguauccagaggucuggccgcugcaggcgaggccauccggagaugcuucuccugcugcaaaggcagcacccacagguaugcucccagggaugaucuuucucccgagggagccagccuggcugagacucuugcaagauucgccgaugacauggggaucgagcggggcgcugacggcaccuacgacauuccccugguggacgacuggaggaggggagugcccuccaucgagggcgagggcuccgauucaaucuaugagaucaugaugccuauuuacgaggugaugaacauggaccuggagacaagaagaaguuucgccguccagcagggucauuaccaggacccccgagcaagcgacuacgaucugccucgcgccagcgauuacgaccugccuagaagccccuacccuacaccuccacugcccccaagauaucagcuccagaacauggacguggaggccggcuucagggaggccguguacgccagcuuuguggccggcauguacaacuaugucgugacacagccucaggaacgcauucccaauagccaacagguggagggcauccugagagacaugcugaccaacggcucucagacuuuuagagaucugaugaaaagauggaacagagaaguggacagggag

SEQ ID NO: 379 - RNA, 1833 nt, Artificial Sequence
  Synthetic Polynucleotide
auggaaacaccagcucagcuccuuuucuuacuccucuugugguugccggauaccacaggcaugagcauccggggcgucggcggcaacggaaacagccggauccccagccacaacggagacggcucuaauagaagaucacagaauaccaagggaaauaacaaggucgaagauagagucugcagcuuauauuccagcagauccaacgagaauagggaaagccccuacgccgucguugacgugagcuccaugaucgaaagcaccccaacaaguggcgagacuacaagagccucaaggggcguccugucaagauuccaaagaggccuggugaggaucgcagacaaggugcggcgggccgugcagugcgccuggagcucugugucgacaagcagaucaagugccaccagggccgccgagagcggauccuccagucggaccgcccgcggcgccucuaguggguacagagaauauagucccagcgccgcuagggggcugcgccucauguucaccgacuucuggagaacccgcgugcucaggcagacauccccuauggccgggguguucggcaaccuggacgugaacgaggcccggcuuauggccgcauauacaagcgagugugccgaccaccuggaggccaaggagcuggcuggccccgacggcguggccgccgcacgcgagauugccaagaggugggaaaagagggugagagaucugcaggauaagggcgccgccagaaaacugcugaaugacccccuggggaggaggacacccaauuaccagucaaagaauccaggggaguacacuguuggaaauucuauguuuuaugacggcccucagguggccaaccuucagaauguggacacaggcuucuggcuugacaugagcaaccucagcgacguggugcugucuagggagauccagacaggcuuaagagcacgggcuacccuggaagagucgaugcccaugcucgaaaaucuggaggagagguucagacgccugcaagagacaugcgacgccgcgaggacugaaaucgaggagagcggcuggaccagggaguccgcuucucgcauggaaggggacgaggcucagggccccagcagggugcagcaggccuuccagagcuuugugaacgagugcaacuccauugaguucagcuuuggaagcuucggagagcacgugcgggugcugugcgcccgcguguccaggggccuggccgcagcuggcgaggcuauacgucgcugcuucagcuguuguaagggaagcacccauagguacgccccucgugacgaucugucucccgaaggggccagccuggcugagacacuggcccgcuucgccgaugauauggggauugaacggggcgccgacggaaccuacgacaucccucuuguggacgacuggaggagaggcguccccucuaucgagggcgagggcucugacuccaucuacgagauuaugaugccuaucuacgaggucaugaacauggaccuggaaaccagaagaagcuucgcaguucagcagggacacuaccaagacccacgggcuagugauuaugaccucccaagagcauccgacuaugaucugccaaggucaccuuacccuaccccaccccugcccccacgguaccaguuacagaacauggauguggaggccggcuucagggaagccgucuaugcauccuucguggccggcauguacaacuacguggugacucaaccucaggaacggauccccaacagucagcagguggaggggauccuuagggauaugcugacuaauggaagccagaccuucagagaucugaugaagcgguggaauagggagguggacagggag

SEQ ID NO: 380 - RNA, 1833 nt, Artificial Sequence
  Synthetic Polynucleotide
auggagacacccgcacagcuccucuucuuauugcucuuguggcuaccggacaccacaggcaugucuauccggggcguuggcgggaacggcaacucuaggauccccucucacaacggcgacgggagcaacaggagaagccagaacaccaaaggcaauaacaaagucgaggacagaguuuguucucucuauagcucuaggagcaacgaaaaccgcgaaucuccuuacgccgucgucgacgucagcagcaugauagagucaaccccuaccucuggagaaacaacacgcgccuccagaggcguucuguccagguuccagaggggccuggugagaauugccgacaaggucagacgagccgugcagugugccugguccagcgucucuaccagcagaagcuccgccaccagagccgcugagaguggcagcuccagcaggacagccaggggggcuuccagcggcuauagagaguauagcccuucagccgccagaggccugcggcugauguucacagacuuuuggagaacaagggugcugcggcagaccagccccauggccggcguguuuggcaaucuggacgugaacgaggcccggcugauggccgcauacaccagcgagugugcggaccaccuggaggcaaaggagcuggcuggacccgacgguguggccgcugcccgagaaauugccaagaggugggagaagagaguucgcgaccugcaggauaagggcgccgcacggaaacuccugaacgacccacucggcagaagaacccccaacuaccagucaaagaacccuggggaguauaccgugggaaauucaauguucuacgauggcccucagguugcuaaucuccagaacguggacacuggguucuggcuggacaugagcaaccugagugacguggugcugucucgggaaauucagacaggccugcgggccagagccacccuggaagaguccaugccuaugcuugagaaccuggaggagcgcuuuaggcgacuccaagaaaccugcgaugcugccaggaccgagaucgaggagucuggauggaccagagaaagcgccuccaggauggagggcgaugaggcccagggccccagcagggugcagcaggcuuuccagagcuucgugaacgaauguaacaguaucgaauucucuuucgguagcuucggcgagcacgugcggguguuaugcgccagggucagcaggggccuggcggccgccggcgaggccaucagaagaugcuucagcuguugcaaaggcucaacccacagauaugccccuagggacgaucugucuccagagggcgcuagcuuggccgagacacuagcaagguucgccgacgauauggguaucgagaggggcgccgacgguaccuacgacaucccccugguggacgacuggaggagaggcgugcccaguauugagggcgagggauccgacagcaucuacgagaucaugaugccgaucuacgaggugaugaauauggaucuggagacucguagaucauucgcuguccagcagggccacuaccaggauccuagagccucggacuacgacuugcccagggcuagcgauuacgaccugccuagaucccccuaccccacucccccucuucccccucgguaucagcugcagaacauggacguggaggccgguuuccgagaggcuguguacgccuccuucguggccgggauguacaacuacgucgugacccagccccaggagagaaucccuaauucccagcagguggagggcaucuugagagauaugcucacaaacgggagccagaccuuucgugacuuaaugaagcgauggaacagagagguggauagggag

SEQ ID NO: 381 - RNA, 1833 nt, Artificial Sequence
  Synthetic Polynucleotide
auggaaacccccgcccagcuucucuuccuccucuugcuuuggcucccagacacaaccggcaugaguaucagaggcguaggaggcaacggcaauagccguauccccucacacaacggcgacggcuccaacagacggagccagaacaccaaggggaauaauaagguggaggaccgggucuguucacuuuacagcuccaggucuaacgagaaucgggaaagcccuuacgccguagucgacguuagcaguaugaucgaaagcacccccaccagcggcgagacaacaagggccucucgaggaguucugagcagauuucagagaggccuggugcggaucgccgacaaggugcggagagccgugcagugcgccuggagcagcgugaguacaucucggagcagcgccaccagagcagccgaaagcggcucaucuagcaggaccgcuagaggcgccagcucgggguacagggaauauucacccuccgccgcaagggggcugagacugauguuuacagacuucuggagaaccagggugcugcgccagacaagcccaauggcagggguguuugguaaccuggaugugaaugaggccagacugauggccgccuacacuucugagugcgcggaucaucuugaggccaaggaacuggcaggccccgacggcguggccgccgcccgggagauugcuaagagaugggagaagcgggucagagaucugcaggauaagggggccgcuaggaaacuccugaaugacccccuaggcaggagaaccccuaacuaccagagcaaaaauccuggggaauacaccgugggcaauuccauguuuuacgauggcccccaagucgcaaaccuccagaauguggacaccggcuucuggcuggacauguccaacuugagcgacgugguucuaagcagagaaauccagaccggacuccgcgcgagagcuacacucgaggaaagcaugccuaugcuggagaaucuggaggagcgauuccgucgucuacaggagacuugugacgccgcuaggaccgagaucgaggagagcggcuggacaagagaaagcgccucucgaauggagggcgaugaggcccagggccccucccgggugcagcaggccuuucagagcuucgugaaugagugcaauucuauugaguucagcuucggcucuuuuggcgagcacgugcgggugcuuugcgccagggugucccggggacuggcagccgccggcgaggccauaagaagauguuucuccugcugcaagggcagcacccaccgguaugcucccagagacgaccugucuccagaaggggcaucgcuggccgagacacuggcacgguucgccgacgauaugggcauugagaggggagccgacggcacuuaugauaucccucucguggacgacuggagaagaggaguccccucaauugagggcgaaggauccgauucuaucuaugagaucaugaugccuaucuacgaagugaugaauauggaccuggaaaccaggagaucuuucgcugugcagcagggccauuaccaggauccccgcgccagcgauuaugaccugcccagagccucagacuacgauuugcccagaagccccuaccccaccccuccgcugcccccuagauaccagcugcagaauauggacguggaggcuggcuuuagggaggcuguguacgcuagcuucguggccggcauguacaacuacguggugacacagccccaggagagaauucccaauucucaacaaguagagggcauccugagagacauguuaacaaacggaucucagaccuuccgcgaccugaugaagcgguggaaccgggaaguggaccgcgag

SEQ ID NO: 382 - RNA, 1851 nt, Artificial Sequence
  Synthetic Polynucleotide
auggaaacacccgcccagcuccucuuucuacuucuccuuuggcuucccgacaccaccgguaugagcauuagaggagucggcgggaacgggaauagccguauccccucccacaacggcgacggcagcaaccgcagaagccagaauacuaagggaaacaauaagguugaggaccgcgucuguagcuuguacagcucaagaaguaacgagaacagagagagccccuacgccguggucgacguuuccagcaugaucgagucaacgcccacaagcggcgaaaccacccgcgcgucaagggggguccugucccgguuccagagaggccuggugaggaucgccgacaaggugagacgggccgugcagugcgccugguccagcgucagcacaucacgguccuccgcuaccagggccgccgagucaggcagcagcucucguaccgcccggggagccucaagcggguacagagaguacagcccuucugccgcuagaggccugagacucauguuuacagacuucuggcggacaaggguucucaggcagacuagcccuauggcuggcguguuuggcaaucuugauguuaacgaagccaggcugauggcugcauauacaagcgaaugcgccgaccaucuggaagcuaaggagcuggccgggcccgacggcguggccgcugccagggagaucgccaagaggugggagaaaagggugcgagaucuccaggauaagggagcagcuagaaagcugcugaacgacccccugggcaggcggaccccuaacuaccagagcaaaaauccgggcgaguacaccgucggcaacagcauguuuuacgauggcccucagguggccaaccuucagaacguggacaccggcuucuggcucgauaugucuaaucuuuccgacgucgugcucagccgggaaauccagacuggucugcgcgccagagcuaccuuggaagagagcaugcccaugcuggagaaccuggaggagagauuucggcgcuuacaggaaacaugugacgcugcuaggaccgagauugaagagagcggguggacaagggagucggcgagcaggauggagggggacgaggcccagggccccagcagggugcaacaggcuuuucaguccuucgugaacgagugcaacagcaucgaguucuccuucggcagcuucggggagcacgugagaguguugugcgcccgcgugucuaggggauuagccgccgcaggcgaagccauccggcgcugcuucagcugcugcaagggcuccacccaucgcuacgccccuagagacgaccugucucccgaaggcgccucccuggccgagacucuggcccgauucgccgaugacaugggcaucgagcggggggccgauggcaccuacgacaucccucuggucgaugacuggcggaggggcguucccucuauugagggcgagggcucugacucuauuuacgagauuaugaugcccaucuacgaagugaugaacauggacuuggaaacucgcagaucguuugcagugcaacagggucauuaccaggacccuagagccuccgauuaugaccugccaagagcuagcgauuaugaccucccuagaucacccuaccccacaccuccucucccuccacgguaucagcugcagaacauggacguugaggcaggguuuagggaggccguguacgccagcuucguggcaggcauguauaauuaugugguaacccagccacaggagcgaauucccaacucucaacagguggagggcauccugagagacaugcucaccaacggcagccaaaccuucagggaccuuaugaaacgguggaauagagaaguugaucgcgagcaccaccaccaccaccac

SEQ ID NO: 383 - RNA, 1851 nt, Artificial Sequence
  Synthetic Polynucleotide
auggaaacucccgcacaguuacuuuucuuguugcuucuauggcuccccgauaccaccgggaugagcaucagaggcgucggcgggaacggcaacagcagaauucccucccacaacggcgacggcagcaacagaagaucccagaacacaaagggcaauaauaaggucgaggacagagugugcagccucuacuccagcaggucuaacgagaauagggaguccccguacgccguugucgacgugaguucuaugauagagagcacgcccacguccggagaaacaacuagagcaagcaggggcguccugagccgguuccagagaggucuggugcgaauugccgacaaggugagacgggcagugcaaugcgccuggagcagcgucuccaccagcagaagcagcgccacccgcgcugccgaaucaggcagcagcuccagaacggcacggggcgccuccuccggcuaccgagaguacuccccuagcgccgccagaggccugagacugauguucaccgauuuuuggaggacacggguucugagacagaccucccccauggcugggguguucggcaaccuggacgucaaugaagccagacucauggccgcauauacuucugagugcgcugaccaccuggaagcuaaggaacuggcgggccccgauggcguggccgcggcccgggagaucgccaagagaugggagaagagagugcgggaccugcaagacaagggggccgcccggaagcugcugaacgaucccuugggccgccggacaccgaacuaucagagcaagaacccgggcgaguacaccgugggaaacagcauguucuaugacggaccucagguggcaaaccugcagaacguggacacuggauuuuggcucgacaugaguaaccucuccgaugucguucugucucgugagauacagacaggucugcgggcuagagccacccuugaggagagcaugccuauguuggagaaucuggaggagcgguucagaagacugcaggagacuugcgaugccgccaggaccgagauugaggagagcggcuggacccgggaaagcgccucaaggauggagggagacgaggcccagggacccuccaggguucagcaggccuuccagucguucgugaaugaaugcaacagcaucgaguucagcuucggaagcuucggagagcacgugcgagugcugugcgccagaguauccagaggucuggccgcugcaggcgaggccauccggagaugcuucuccugcugcaaaggcagcacccacagguaugcucccagggaugaucuuucucccgagggagccagccuggcugagacucuugcaagauucgccgaugacauggggaucgagcggggcgcugacggcaccuacgacauuccccugguggacgacuggaggaggggagugcccuccaucgagggcgagggcuccgauucaaucuaugagaucaugaugccuauuuacgaggugaugaacauggaccuggagacaagaagaaguuucgccguccagcagggucauuaccaggacccccgagcaagcgacuacgaucugccucgcgccagcgauuacgaccugccuagaagccccuacccuacaccuccacugcccccaagauaucagcuccagaacauggacguggaggccggcuucagggaggccguguacgccagcuuuguggccggcauguacaacuaugucgugacacagccucaggaacgcauucccaauagccaacagguggagggcauccugagagacaugcugaccaacggcucucagacuuuuagagaucugaugaaaagauggaacagagaaguggacagggagcaccaccaccaccaccac

SEQ ID NO: 384 - RNA, 1851 nt, Artificial Sequence
  Synthetic Polynucleotide
auggaaacaccagcucagcuccuuuucuuacuccucuugugguugccggauaccacaggcaugagcauccggggcgucggcggcaacggaaacagccggauccccagccacaacggagacggcucuaauagaagaucacagaauaccaagggaaauaacaaggucgaagauagagucugcagcuuauauuccagcagauccaacgagaauagggaaagccccuacgccgucguugacgugagcuccaugaucgaaagcaccccaacaaguggcgagacuacaagagccucaaggggcguccugucaagauuccaaagaggccuggugaggaucgcagacaaggugcggcgggccgugcagugcgccuggagcucugugucgacaagcagaucaagugccaccagggccgccgagagcggauccuccagucggaccgcccgcggcgccucuaguggguacagagaauauagucccagcgccgcuagggggcugcgccucauguucaccgacuucuggagaacccgcgugcucaggcagacauccccuauggccgggguguucggcaaccuggacgugaacgaggcccggcuuauggccgcauauacaagcgagugugccgaccaccuggaggccaaggagcuggcuggccccgacggcguggccgccgcacgcgagauugccaagaggugggaaaagagggugagagaucugcaggauaagggcgccgccagaaaacugcugaaugacccccuggggaggaggacacccaauuaccagucaaagaauccaggggaguacacuguuggaaauucuauguuuuaugacggcccucagguggccaaccuucagaauguggacacaggcuucuggcuugacaugagcaaccucagcgacguggugcugucuagggagauccagacaggcuuaagagcacgggcuacccuggaagagucgaugcccaugcucgaaaaucuggaggagagguucagacgccugcaagagacaugcgacgccgcgaggacugaaaucgaggagagcggcuggaccagggaguccgcuucucgcauggaaggggacgaggcucagggccccagcagggugcagcaggccuuccagagcuuugugaacgagugcaacuccauugaguucagcuuuggaagcuucggagagcacgugcgggugcugugcgcccgcguguccaggggccuggccgcagcuggcgaggcuauacgucgcugcuucagcuguuguaagggaagcacccauagguacgccccucgugacgaucugucucccgaaggggccagccuggcugagacacuggcccgcuucgccgaugauauggggauugaacggggcgccgacggaaccuacgacaucccucuuguggacgacuggaggagaggcguccccucuaucgagggcgagggcucugacuccaucuacgagauuaugaugccuaucuacgaggucaugaacauggaccuggaaaccagaagaagcuucgcaguucagcagggacacuaccaagacccacgggcuagugauuaugaccucccaagagcauccgacuaugaucugccaaggucaccuuacccuaccccaccccugcccccacgguaccaguuacagaacauggauguggaggccggcuucagggaagccgucuaugcauccuucguggccggcauguacaacuacguggugacucaaccucaggaacggauccccaacagucagcagguggaggggauccuuagggauaugcugacuaauggaagccagaccuucagagaucugaugaagcgguggaauagggagguggacagggagcaccaucaccaucaccac

SEQ ID NO: 385 - RNA, 1851 nt, Artificial Sequence
  Synthetic Polynucleotide
auggagacacccgcacagcuccucuucuuauugcucuuguggcuaccggacaccacaggcaugucuauccggggcguuggcgggaacggcaacucuaggauccccucucacaacggcgacgggagcaacaggagaagccagaacaccaaaggcaauaacaaagucgaggacagaguuuguucucucuauagcucuaggagcaacgaaaaccgcgaaucuccuuacgccgucgucgacgucagcagcaugauagagucaaccccuaccucuggagaaacaacacgcgccuccagaggcguucuguccagguuccagaggggccuggugagaauugccgacaaggucagacgagccgugcagugugccugguccagcgucucuaccagcagaagcuccgccaccagagccgcugagaguggcagcuccagcaggacagccaggggggcuuccagcggcuauagagaguauagcccuucagccgccagaggccugcggcugauguucacagacuuuuggagaacaagggugcugcggcagaccagccccauggccggcguguuuggcaaucuggacgugaacgaggcccggcugauggccgcauacaccagcgagugugcggaccaccuggaggcaaaggagcuggcuggacccgacgguguggccgcugcccgagaaauugccaagaggugggagaagagaguucgcgaccugcaggauaagggcgccgcacggaaacuccugaacgacccacucggcagaagaacccccaacuaccagucaaagaacccuggggaguauaccgugggaaauucaauguucuacgauggcccucagguugcuaaucuccagaacguggacacuggguucuggcuggacaugagcaaccugagugacguggugcugucucgggaaauucagacaggccugcgggccagagccacccuggaagaguccaugccuaugcuugagaaccuggaggagcgcuuuaggcgacuccaagaaaccugcgaugcugccaggaccgagaucgaggagucuggauggaccagagaaagcgccuccaggauggagggcgaugaggcccagggccccagcagggugcagcaggcuuuccagagcuucgugaacgaauguaacaguaucgaauucucuuucgguagcuucggcgagcacgugcggguguuaugcgccagggucagcaggggccuggcggccgccggcgaggccaucagaagaugcuucagcuguugcaaaggcucaacccacagauaugccccuagggacgaucugucuccagagggcgcuagcuuggccgagacacuagcaagguucgccgacgauauggguaucgagaggggcgccgacgguaccuacgacaucccccugguggacgacuggaggagaggcgugcccaguauugagggcgagggauccgacagcaucuacgagaucaugaugccgaucuacgaggugaugaauauggaucuggagacucguagaucauucgcuguccagcagggccacuaccaggauccuagagccucggacuacgacuugcccagggcuagcgauuacgaccugccuagaucccccuaccccacucccccucuucccccucgguaucagcugcagaacauggacguggaggccgguuuccgagaggcuguguacgccuccuucguggccgggauguacaacuacgucgugacccagccccaggagagaaucccuaauucccagcagguggagggcaucuugagagauaugcucacaaacgggagccagaccuuucgugacuuaaugaagcgauggaacagagagguggauagggagcaccaccaucaccaccac

SEQ ID NO: 386 - RNA, 1851 nt, Artificial Sequence
  Synthetic Polynucleotide
auggaaacccccgcccagcuucucuuccuccucuugcuuuggcucccagacacaaccggcaugaguaucagaggcguaggaggcaacggcaauagccguauccccucacacaacggcgacggcuccaacagacggagccagaacaccaaggggaauaauaagguggaggaccgggucuguucacuuuacagcuccaggucuaacgagaaucgggaaagcccuuacgccguagucgacguuagcaguaugaucgaaagcacccccaccagcggcgagacaacaagggccucucgaggaguucugagcagauuucagagaggccuggugcggaucgccgacaaggugcggagagccgugcagugcgccuggagcagcgugaguacaucucggagcagcgccaccagagcagccgaaagcggcucaucuagcaggaccgcuagaggcgccagcucgggguacagggaauauucacccuccgccgcaagggggcugagacugauguuuacagacuucuggagaaccagggugcugcgccagacaagcccaauggcagggguguuugguaaccuggaugugaaugaggccagacugauggccgccuacacuucugagugcgcggaucaucuugaggccaaggaacuggcaggccccgacggcguggccgccgcccgggagauugcuaagagaugggagaagcgggucagagaucugcaggauaagggggccgcuaggaaacuccugaaugacccccuaggcaggagaaccccuaacuaccagagcaaaaauccuggggaauacaccgugggcaauuccauguuuuacgauggcccccaagucgcaaaccuccagaauguggacaccggcuucuggcuggacauguccaacuugagcgacgugguucuaagcagagaaauccagaccggacuccgcgcgagagcuacacucgaggaaagcaugccuaugcuggagaaucuggaggagcgauuccgucgucuacaggagacuugugacgccgcuaggaccgagaucgaggagagcggcuggacaagagaaagcgccucucgaauggagggcgaugaggcccagggccccucccgggugcagcaggccuuucagagcuucgugaaugagugcaauucuauugaguucagcuucggcucuuuuggcgagcacgugcgggugcuuugcgccagggugucccggggacuggcagccgccggcgaggccauaagaagauguuucuccugcugcaagggcagcacccaccgguaugcucccagagacgaccugucuccagaaggggcaucgcuggccgagacacuggcacgguucgccgacgauaugggcauugagaggggagccgacggcacuuaugauaucccucucguggacgacuggagaagaggaguccccucaauugagggcgaaggauccgauucuaucuaugagaucaugaugccuaucuacgaagugaugaauauggaccuggaaaccaggagaucuuucgcugugcagcagggccauuaccaggauccccgcgccagcgauuaugaccugcccagagccucagacuacgauuugcccagaagccccuaccccaccccuccgcugcccccuagauaccagcugcagaauauggacguggaggcuggcuuuagggaggcuguguacgcuagcuucguggccggcauguacaacuacguggugacacagccccaggagagaauucccaauucucaacaaguagagggcauccugagagacauguuaacaaacggaucucagaccuuccgcgaccugaugaagcgguggaaccgggaaguggaccgcgagcaccaccaccaccaucau

SEQ ID NO: 387 - RNA, 1899 nt, Artificial Sequence
  Synthetic Polynucleotide
auggaaaccccugcccagcugcuguuccugcugcugcuguggcugccugacaccaccggcgacuauaaagaccacgauggcgauuacaaagaucacgacaucgauuacaaggaugacgacgacaaaaugagcaucagaggcgugggcggcaacggcaacagcagaaucccuagccacaacggcgacggcagcaacaggcggagccagaacaccaagggcaacaacaagguggaagauagagugugcagccuguacagcagccgguccaacgagaaccgcgagagcccuuaugccgugguggacguguccagcaugaucgagagcacccccaccagcggcgagacaaccagagcuaguagaggcgugcugagccgguuccagaggggccucgugcggauugcugacaaagugcggagagccgugcagugcgcuuggagcagcguguccacaagcagaagcagcgccacaagagccgccgagagcggcagcucuagcagaacagcuagaggcgccagcagcggcuacagagaguacagcccuucugccgcucggggccugcggcugauguucaccgacuuuuggcggacccgggugcugagacagaccucuccuauggccggcguguucggcaaccuggacgugaacgaggccagacugauggccgccuacaccagcgagugugccgaucaccuggaagccaaagagcuggccggaccugacggcguggcagccgcuagagaaaucgccaagagaugggagaagagagugcgggaccugcaggacaagggcgcugccagaaagcugcugaacgacccccugggcagacggacccccaacuaccagagcaagaaccccggcgaguacaccgugggcaacuccauguucuacgacggcccccagguggccaaccugcagaauguggauaccggcuucuggcuggacaugagcaaccugagcgacguggugcuguccagagagauccagaccggccugagagccagagccacccuggaagaguccaugcccaugcuggaaaaucuggaagagagauuccggcggcugcaggaaaccugcgacgccgccagaaccgagaucgaggaaagcggcuggacccgggaaagcgccuccagaauggaaggcgacgaagcccagggccccagcagagugcagcaggccuuucagagcuucgugaaugagugcaacagcaucgaguucagcuucggcuccuucggcgagcacgugcgggugcugugugccagagugucaagaggacuggccgcugccggcgaggccaucagaagaugcuucagcugcugcaagggcagcacccacagauacgcccccagagaugaccugucuccugagggcgccucucuggccgaaacccuggccagauucgccgacgacaugggcaucgaaagaggcgccgacggcaccuacgacaucccccugguggacgauuggagaaggggcgugccauccaucgagggcgagggcagcgauagcaucuacgagaucaugaugcccaucuacgaagugaugaacauggaccuggaaacccggcggagcuucgccgugcagcagggccauuaccaggaccccagagccagcgacuacgaccugccuagagccuccgauuacgaucugcccagaagccccuaccccaccccuccacugccucccagauaccagcugcagaacauggauguggaagccggcuuucgcgaggccguguacgccucuuuuguggccggcauguacaacuacgucgugacccagccccaggaacggauccccaauagccagcagguggaaggcauccugcgggacaugcugaccaacggcagccagaccuuccgggaccugaugaagcgguggaacagagagguggaccgcgag

SEQ ID NO: 388 - RNA, 1899 nt, Artificial Sequence
  Synthetic Polynucleotide
auggaaaccccugcccagcugcuguuccugcugcugcuguggcugccugacaccaccggcaugagcaucagaggcgugggcggcaacggcaacagcagaaucccuagccacaacggcgacggcagcaacaggcggagccagaacaccaagggcaacaacaagguggaagauagagugugcagccuguacagcagccgguccaacgagaaccgcgagagcccuuaugccgugguggacguguccagcaugaucgagagcacccccaccagcggcgagacaaccagagcuaguagaggcgugcugagccgguuccagaggggccucgugcggauugcugacaaagugcggagagccgugcagugcgcuuggagcagcguguccacaagcagaagcagcgccacaagagccgccgagagcggcagcucuagcagaacagcuagaggcgccagcagcggcuacagagaguacagcccuucugccgcucggggccugcggcugauguucaccgacuuuuggcggacccgggugcugagacagaccucuccuauggccggcguguucggcaaccuggacgugaacgaggccagacugauggccgccuacaccagcgagugugccgaucaccuggaagccaaagagcuggccggaccugacggcguggcagccgcuagagaaaucgccaagagaugggagaagagagugcgggaccugcaggacaagggcgcugccagaaagcugcugaacgacccccugggcagacggacccccaacuaccagagcaagaaccccggcgaguacaccgugggcaacuccauguucuacgacggcccccagguggccaaccugcagaauguggauaccggcuucuggcuggacaugagcaaccugagcgacguggugcuguccagagagauccagaccggccugagagccagagccacccuggaagaguccaugcccaugcuggaaaaucuggaagagagauuccggcggcugcaggaaaccugcgacgccgccagaaccgagaucgaggaaagcggcuggacccgggaaagcgccuccagaauggaaggcgacgaagcccagggccccagcagagugcagcaggccuuucagagcuucgugaaugagugcaacagcaucgaguucagcuucggcuccuucggcgagcacgugcgggugcugugugccagagugucaagaggacuggccgcugccggcgaggccaucagaagaugcuucagcugcugcaagggcagcacccacagauacgcccccagagaugaccugucuccugagggcgccucucuggccgaaacccuggccagauucgccgacgacaugggcaucgaaagaggcgccgacggcaccuacgacaucccccugguggacgauuggagaaggggcgugccauccaucgagggcgagggcagcgauagcaucuacgagaucaugaugcccaucuacgaagugaugaacauggaccuggaaacccggcggagcuucgccgugcagcagggccauuaccaggaccccagagccagcgacuacgaccugccuagagccuccgauuacgaucugcccagaagccccuaccccaccccuccacugccucccagauaccagcugcagaacauggauguggaagccggcuuucgcgaggccguguacgccucuuuuguggccggcauguacaacuacgucgugacccagccccaggaacggauccccaauagccagcagguggaaggcauccugcgggacaugcugaccaacggcagccagaccuuccgggaccugaugaagcgguggaacagagagguggaccgcgaggacuauaaagaccacgauggcgauuacaaagaucacgacaucgauuacaaggaugacgacgacaaa

SEQ ID NO: 389 - RNA, 1851 nt, Artificial Sequence
  Synthetic Polynucleotide
auggaaaccccugcccagcugcuguuccugcugcugcuguggcugccugacaccaccggccaccaccaucaccaccacaugagcaucagaggcgugggcggcaacggcaacagcagaaucccuagccacaacggcgacggcagcaacaggcggagccagaacaccaagggcaacaacaagguggaagauagagugugcagccuguacagcagccgguccaacgagaaccgcgagagcccuuaugccgugguggacguguccagcaugaucgagagcacccccaccagcggcgagacaaccagagcuaguagaggcgugcugagccgguuccagaggggccucgugcggauugcugacaaagugcggagagccgugcagugcgcuuggagcagcguguccacaagcagaagcagcgccacaagagccgccgagagcggcagcucuagcagaacagcuagaggcgccagcagcggcuacagagaguacagcccuucugccgcucggggccugcggcugauguucaccgacuuuuggcggacccgggugcugagacagaccucuccuauggccggcguguucggcaaccuggacgugaacgaggccagacugauggccgccuacaccagcgagugugccgaucaccuggaagccaaagagcuggccggaccugacggcguggcagccgcuagagaaaucgccaagagaugggagaagagagugcgggaccugcaggacaagggcgcugccagaaagcugcugaacgacccccugggcagacggacccccaacuaccagagcaagaaccccggcgaguacaccgugggcaacuccauguucuacgacggcccccagguggccaaccugcagaauguggauaccggcuucuggcuggacaugagcaaccugagcgacguggugcuguccagagagauccagaccggccugagagccagagccacccuggaagaguccaugcccaugcuggaaaaucuggaagagagauuccggcggcugcaggaaaccugcgacgccgccagaaccgagaucgaggaaagcggcuggacccgggaaagcgccuccagaauggaaggcgacgaagcccagggccccagcagagugcagcaggccuuucagagcuucgugaaugagugcaacagcaucgaguucagcuucggcuccuucggcgagcacgugcgggugcugugugccagagugucaagaggacuggccgcugccggcgaggccaucagaagaugcuucagcugcugcaagggcagcacccacagauacgcccccagagaugaccugucuccugagggcgccucucuggccgaaacccuggccagauucgccgacgacaugggcaucgaaagaggcgccgacggcaccuacgacaucccccugguggacgauuggagaaggggcgugccauccaucgagggcgagggcagcgauagcaucuacgagaucaugaugcccaucuacgaagugaugaacauggaccuggaaacccggcggagcuucgccgugcagcagggccauuaccaggaccccagagccagcgacuacgaccugccuagagccuccgauuacgaucugcccagaagccccuaccccaccccuccacugccucccagauaccagcugcagaacauggauguggaagccggcuuucgcgaggccguguacgccucuuuuguggccggcauguacaacuacgucgugacccagccccaggaacggauccccaauagccagcagguggaaggcauccugcgggacaugcugaccaacggcagccagaccuuccgggaccugaugaagcgguggaacagagagguggaccgcgag

SEQ ID NO: 390 - RNA, 1179 nt, Artificial Sequence
  Synthetic Polynucleotide
augggcccuggcagaugucugcugacagcccugcugcugcuggcccuggcuccuccaccugaagcucugcccgugggaaauccugccgagcccagccugaugaucgacggcauucugugggagggcuucggcggcgacccuugcgauccuuguaccacuuggugcgacgccaucagcaugagaaugggcuacuacggcgacuucguguucgaccgggugcugaaaaccgacgugaacaaagaauuccagaugggcgacaagcccaccagcaccaccggaaaugccaccgccccuaccacccugaccgccagagaaaaucccgccuacggccggcacaugcaggacgccgagauguucaccaacgccgccugcauggcccugaacaucugggacagauucgacguguucugcacccugggcgccagcagcggcuaccugaagggcaauagcgccagcuucaaccucgugggccuguucggcgacaacgagaaccagagcaccgugaaaacaaacagcgugcccaacaugagccuggaccagagcgugguggaacuguacaccgacaccgcauucucuuggagcgugggagccagagcugcccugugggaguguggaugugccacacugggcgcuagcuuccaguacgcccagagcaagcccaagguggaagaacugaacgugcugugcaaugccgccgaguucaccaucaacaagccuaagggcuacgugggccaggaauucccccuggcccugaucgccggaacagaugccgccaccggaacaaaggacgccagcaucgacuaccacgaguggcaggcuucucuggcccuguccuaccggcugaauauguucacccccuacaucggcgugaaguggucccgggccagcuucgaugccgacaccaucagaaucgcccagcccaagagcgccaccgccaucuucgauaccaccacacugaaccccaccauugccggcgcuggcgacgugaaagccucugccgaaggacagcugggcgacacaaugcagaucgugucccugcagcugaacaagaugaagucccggaaguccugcggaaucgccgugggcaccacaaucguggacgccgauaaguacgccgugaccguggaaacccggcugaucgaugagagggccgcucacgugaacgcccaguucagauuc

SEQ ID NO: 391 - RNA, 1197 nt, Artificial Sequence
  Synthetic Polynucleotide
augggcccuggcagaugucugcugacagcccugcugcugcuggcccuggcuccuccaccugaagcucugcccgugggaaauccugccgagcccagccugaugaucgacggcauucugugggagggcuucggcggcgacccuugcgauccuuguaccacuuggugcgacgccaucagcaugagaaugggcuacuacggcgacuucguguucgaccgggugcugaaaaccgacgugaacaaagaauuccagaugggcgacaagcccaccagcaccaccggaaaugccaccgccccuaccacccugaccgccagagaaaaucccgccuacggccggcacaugcaggacgccgagauguucaccaacgccgccugcauggcccugaacaucugggacagauucgacguguucugcacccugggcgccagcagcggcuaccugaagggcaauagcgccagcuucaaccucgugggccuguucggcgacaacgagaaccagagcaccgugaaaacaaacagcgugcccaacaugagccuggaccagagcgugguggaacuguacaccgacaccgcauucucuuggagcgugggagccagagcugcccugugggaguguggaugugccacacugggcgcuagcuuccaguacgcccagagcaagcccaagguggaagaacugaacgugcugugcaaugccgccgaguucaccaucaacaagccuaagggcuacgugggccaggaauucccccuggcccugaucgccggaacagaugccgccaccggaacaaaggacgccagcaucgacuaccacgaguggcaggcuucucuggcccuguccuaccggcugaauauguucacccccuacaucggcgugaaguggucccgggccagcuucgaugccgacaccaucagaaucgcccagcccaagagcgccaccgccaucuucgauaccaccacacugaaccccaccauugccggcgcuggcgacgugaaagccucugccgaaggacagcugggcgacacaaugcagaucgugucccugcagcugaacaagaugaagucccggaaguccugcggaaucgccgugggcaccacaaucguggacgccgauaaguacgccgugaccguggaaacccggcugaucgaugagagggccgcucacgugaacgcccaguucagauuccaccaccaccaucaccac

SEQ ID NO: 392 - RNA, 1218 nt, Artificial Sequence
  Synthetic Polynucleotide
augggccugcagaccaccaaguggccuagccacggcgcauucuuucugaaguccuggcugaucaucucccugggccuguacagccagguguccaagcugcuggcucugcccgugggaaauccugccgagcccagccugaugaucgacggcauucugugggagggcuucggcggcgacccuugcgauccuuguaccacuuggugcgacgccaucagcaugagaaugggcuacuacggcgacuucguguucgaccgggugcugaaaaccgacgugaacaaagaauuccagaugggcgacaagcccaccagcaccaccggaaaugccaccgccccuaccacccugaccgccagagaaaaucccgccuacggccggcacaugcaggacgccgagauguucaccaacgccgccugcauggcccugaacaucugggacagauucgacguguucugcacccugggcgccagcagcggcuaccugaagggcaauagcgccagcuucaaccucgugggccuguucggcgacaacgagaaccagagcaccgugaaaacaaacagcgugcccaacaugagccuggaccagagcgugguggaacuguacaccgacaccgcauucucuuggagcgugggagccagagcugcccugugggaguguggaugugccacacugggcgcuagcuuccaguacgcccagagcaagcccaagguggaagaacugaacgugcugugcaaugccgccgaguucaccaucaacaagccuaagggcuacgugggccaggaauucccccuggcccugaucgccggaacagaugccgccaccggaacaaaggacgccagcaucgacuaccacgaguggcaggcuucucuggcccuguccuaccggcugaauauguucacccccuacaucggcgugaaguggucccgggccagcuucgaugccgacaccaucagaaucgcccagcccaagagcgccaccgccaucuucgauaccaccacacugaaccccaccauugccggcgcuggcgacgugaaagccucugccgaaggacagcugggcgacacaaugcagaucgugucccugcagcugaacaagaugaagucccggaaguccugcggaaucgccgugggcaccacaaucguggacgccgauaaguacgccgugaccguggaaacccggcugaucgaugagagggccgcucacgugaacgcccaguucagauuc

SEQ ID NO: 393 - RNA, 1236 nt, Artificial Sequence
  Synthetic Polynucleotide
augggccugcagaccaccaaguggccuagccacggcgcauucuuucugaaguccuggcugaucaucucccugggccuguacagccagguguccaagcugcuggcucugcccgugggaaauccugccgagcccagccugaugaucgacggcauucugugggagggcuucggcggcgacccuugcgauccuuguaccacuuggugcgacgccaucagcaugagaaugggcuacuacggcgacuucguguucgaccgggugcugaaaaccgacgugaacaaagaauuccagaugggcgacaagcccaccagcaccaccggaaaugccaccgccccuaccacccugaccgccagagaaaaucccgccuacggccggcacaugcaggacgccgagauguucaccaacgccgccugcauggcccugaacaucugggacagauucgacguguucugcacccugggcgccagcagcggcuaccugaagggcaauagcgccagcuucaaccucgugggccuguucggcgacaacgagaaccagagcaccgugaaaacaaacagcgugcccaacaugagccuggaccagagcgugguggaacuguacaccgacaccgcauucucuuggagcgugggagccagagcugcccugugggaguguggaugugccacacugggcgcuagcuuccaguacgcccagagcaagcccaagguggaagaacugaacgugcugugcaaugccgccgaguucaccaucaacaagccuaagggcuacgugggccaggaauucccccuggcccugaucgccggaacagaugccgccaccggaacaaaggacgccagcaucgacuaccacgaguggcaggcuucucuggcccuguccuaccggcugaauauguucacccccuacaucggcgugaaguggucccgggccagcuucgaugccgacaccaucagaaucgcccagcccaagagcgccaccgccaucuucgauaccaccacacugaaccccaccauugccggcgcuggcgacgugaaagccucugccgaaggacagcugggcgacacaaugcagaucgugucccugcagcugaacaagaugaagucccggaaguccugcggaaucgccgugggcaccacaaucguggacgccgauaaguacgccgugaccguggaaacccggcugaucgaugagagggccgcucacgugaacgcccaguucagauuccaccaccaccaucaccac

SEQ ID NO: 394 - RNA, 1173 nt, Artificial Sequence
  Synthetic Polynucleotide
auggaaaccccugcccagcugcuguuccugcugcugcuguggcugccugacaccaccggccugcccgugggaaauccugccgagcccagccugaugaucgacggcauucugugggagggcuucggcggcgacccuugcgauccuuguaccacuuggugcgacgccaucagcaugagaaugggcuacuacggcgacuucguguucgaccgggugcugaaaaccgacgugaacaaagaauuccagaugggcgacaagcccaccagcaccaccggaaaugccaccgccccuaccacccugaccgccagagaaaaucccgccuacggccggcacaugcaggacgccgagauguucaccaacgccgccugcauggcccugaacaucugggacagauucgacguguucugcacccugggcgccagcagcggcuaccugaagggcaauagcgccagcuucaaccucgugggccuguucggcgacaacgagaaccagagcaccgugaaaacaaacagcgugcccaacaugagccuggaccagagcgugguggaacuguacaccgacaccgcauucucuuggagcgugggagccagagcugcccugugggaguguggaugugccacacugggcgcuagcuuccaguacgcccagagcaagcccaagguggaagaacugaacgugcugugcaaugccgccgaguucaccaucaacaagccuaagggcuacgugggccaggaauucccccuggcccugaucgccggaacagaugccgccaccggaacaaaggacgccagcaucgacuaccacgaguggcaggcuucucuggcccuguccuaccggcugaauauguucacccccuacaucggcgugaaguggucccgggccagcuucgaugccgacaccaucagaaucgcccagcccaagagcgccaccgccaucuucgauaccaccacacugaaccccaccauugccggcgcuggcgacgugaaagccucugccgaaggacagcugggcgacacaaugcagaucgugucccugcagcugaacaagaugaagucccggaaguccugcggaaucgccgugggcaccacaaucguggacgccgauaaguacgccgugaccguggaaacccggcugaucgaugagagggccgcucacgugaacgcccaguucagauuc

SEQ ID NO: 395 - RNA, 1191 nt, Artificial Sequence
  Synthetic Polynucleotide
auggaaaccccugcccagcugcuguuccugcugcugcuguggcugccugacaccaccggccugcccgugggaaauccugccgagcccagccugaugaucgacggcauucugugggagggcuucggcggcgacccuugcgauccuuguaccacuuggugcgacgccaucagcaugagaaugggcuacuacggcgacuucguguucgaccgggugcugaaaaccgacgugaacaaagaauuccagaugggcgacaagcccaccagcaccaccggaaaugccaccgccccuaccacccugaccgccagagaaaaucccgccuacggccggcacaugcaggacgccgagauguucaccaacgccgccugcauggcccugaacaucugggacagauucgacguguucugcacccugggcgccagcagcggcuaccugaagggcaauagcgccagcuucaaccucgugggccuguucggcgacaacgagaaccagagcaccgugaaaacaaacagcgugcccaacaugagccuggaccagagcgugguggaacuguacaccgacaccgcauucucuuggagcgugggagccagagcugcccugugggaguguggaugugccacacugggcgcuagcuuccaguacgcccagagcaagcccaagguggaagaacugaacgugcugugcaaugccgccgaguucaccaucaacaagccuaagggcuacgugggccaggaauucccccuggcccugaucgccggaacagaugccgccaccggaacaaaggacgccagcaucgacuaccacgaguggcaggcuucucuggcccuguccuaccggcugaauauguucacccccuacaucggcgugaaguggucccgggccagcuucgaugccgacaccaucagaaucgcccagcccaagagcgccaccgccaucuucgauaccaccacacugaaccccaccauugccggcgcuggcgacgugaaagccucugccgaaggacagcugggcgacacaaugcagaucgugucccugcagcugaacaagaugaagucccggaaguccugcggaaucgccgugggcaccacaaucguggacgccgauaaguacgccgugaccguggaaacccggcugaucgaugagagggccgcucacgugaacgcccaguucagauuccaccaccaccaucaccac

SEQ ID NO: 396 - RNA, 1176 nt, Artificial Sequence
  Synthetic Polynucleotide
augugguggcggcugugguggcuucuccuucuccuccugcugcuguggcccauggugugggcccugcccgugggaaauccugccgagcccagccugaugaucgacggcauucugugggagggcuucggcggcgacccuugcgauccuuguaccacuuggugcgacgccaucagcaugagaaugggcuacuacggcgacuucguguucgaccgggugcugaaaaccgacgugaacaaagaauuccagaugggcgacaagcccaccagcaccaccggaaaugccaccgccccuaccacccugaccgccagagaaaaucccgccuacggccggcacaugcaggacgccgagauguucaccaacgccgccugcauggcccugaacaucugggacagauucgacguguucugcacccugggcgccagcagcggcuaccugaagggcaauagcgccagcuucaaccucgugggccuguucggcgacaacgagaaccagagcaccgugaaaacaaacagcgugcccaacaugagccuggaccagagcgugguggaacuguacaccgacaccgcauucucuuggagcgugggagccagagcugcccugugggaguguggaugugccacacugggcgcuagcuuccaguacgcccagagcaagcccaagguggaagaacugaacgugcugugcaaugccgccgaguucaccaucaacaagccuaagggcuacgugggccaggaauucccccuggcccugaucgccggaacagaugccgccaccggaacaaaggacgccagcaucgacuaccacgaguggcaggcuucucuggcccuguccuaccggcugaauauguucacccccuacaucggcgugaaguggucccgggccagcuucgaugccgacaccaucagaaucgcccagcccaagagcgccaccgccaucuucgauaccaccacacugaaccccaccauugccggcgcuggcgacgugaaagccucugccgaaggacagcugggcgacacaaugcagaucgugucccugcagcugaacaagaugaagucccggaaguccugcggaaucgccgugggcaccacaaucguggacgccgauaaguacgccgugaccguggaaacccggcugaucgaugagagggccgcucacgugaacgcccaguucagauuc

SEQ ID NO: 397 - RNA, 1194 nt, Artificial Sequence
  Synthetic Polynucleotide
augugguggcggcugugguggcuucuccuucuccuccugcugcuguggcccauggugugggcccugcccgugggaaauccugccgagcccagccugaugaucgacggcauucugugggagggcuucggcggcgacccuugcgauccuuguaccacuuggugcgacgccaucagcaugagaaugggcuacuacggcgacuucguguucgaccgggugcugaaaaccgacgugaacaaagaauuccagaugggcgacaagcccaccagcaccaccggaaaugccaccgccccuaccacccugaccgccagagaaaaucccgccuacggccggcacaugcaggacgccgagauguucaccaacgccgccugcauggcccugaacaucugggacagauucgacguguucugcacccugggcgccagcagcggcuaccugaagggcaauagcgccagcuucaaccucgugggccuguucggcgacaacgagaaccagagcaccgugaaaacaaacagcgugcccaacaugagccuggaccagagcgugguggaacuguacaccgacaccgcauucucuuggagcgugggagccagagcugcccugugggaguguggaugugccacacugggcgcuagcuuccaguacgcccagagcaagcccaagguggaagaacugaacgugcugugcaaugccgccgaguucaccaucaacaagccuaagggcuacgugggccaggaauucccccuggcccugaucgccggaacagaugccgccaccggaacaaaggacgccagcaucgacuaccacgaguggcaggcuucucuggcccuguccuaccggcugaauauguucacccccuacaucggcgugaaguggucccgggccagcuucgaugccgacaccaucagaaucgcccagcccaagagcgccaccgccaucuucgauaccaccacacugaaccccaccauugccggcgcuggcgacgugaaagccucugccgaaggacagcugggcgacacaaugcagaucgugucccugcagcugaacaagaugaagucccggaaguccugcggaaucgccgugggcaccacaaucguggacgccgauaaguacgccgugaccguggaaacccggcugaucgaugagagggccgcucacgugaacgcccaguucagauuccaccaccaccaucaccac

SEQ ID NO: 398 - RNA, 1803 nt, Artificial Sequence
  Synthetic Polynucleotide
auggaaaccccugcccagcugcuguuccugcugcugcuguggcugccugauaccacaggcgugcggggagagucccucgugugcaagaaugcccugcaggaccugagcuuccuggaacaucugcugcaagugaaguacgcccccaagaccuggaaagagcaguaccugggcugggaccuggugcaguccucugugucugcccagcagaagcugcggacccaggaaaaccccucuaccagcuucugucagcaagugcuggccgacuucaucggcggccugaacgauuucgccgccggcgugaccuuuuucgccaucgagagcgccuaccugcccuacaccgugcagaaguccagcgacggccgguucuacuucguggacaucaugaccuucagcagcgagaucagagugggcgacgagcugcuggaaguggauggcgcuccugugcaggaugugcuggccacacuguacggcagcaaccacaagggcacagccgccgaagaaucugccgcccugagaacccuguucagccggauggccucucugggccacaaggugccaagcggcagaaccacccugaagaucagacggcccuuuggcaccacccgggaagugcgcgugaaguggcgcuaugugccugagggcgugggcgaccuggccacaaucgccccuucuaucagagccccccagcugcagaaauccaugcggucauucuucccaaagaaggacgacgccuuccaccgguccagcagccuguucuacagcccuauggugccccacuucugggccgagcugagaaaccacuacgccaccuccggccugaaguccggcuacaacaucggcagcaccgacggcuuucugcccgugaucggacccgugaucugggagagcgagggccuguucagagccuacaucagcagcgugaccgacggcgacggcaagagccacaaagugggcuuucugagaauccccaccuacagcuggcaggacauggaagauuucgaccccagcggcccaccccccugggaggaauuugccaagaucauccagguguucagcagcaacaccgaggcccugaucaucgaccagaccaacaacccuggcggcagcgugcuguaccuguacgcccugcugagcaugcugaccgacagaccccuggaacugcccaagcaccggaugauccugacccaggacgaggugguggacgcccuggauuggcugacccugcuggaaaacguggacaccaacguggaaagccggcuggcccugggcgacaacauggaaggcuacacaguggaucugcagguggccgaguaccugaaaagcuucggcagacaggugcugaacugcugguccaagggcgacaucgagcugagcacccccaucccccuguucggcuucgagaagauccacccccaccccagagugcaguacagcaagcccaucugcgugcugaucaacgagcaggacuucuccugcgccgacuucuucccaguggugcugaaggacaacgacagagcccugaucgugggcaccagaacagcuggcgcuggcggcuucguguucaacgugcaguuccccaaccggaccggcaucaagaccuguagccugacaggcucucuggccgugcgggaacacggcgccuucaucgagaacaucggcguggaaccccacaucgaccugccuuucaccgccaacgacauccgguacaagggcuacucugaguaccuggacaaagugaagaaacucgugugccagcugauuaacaacgacggcaccaucauccuggccgaggacggcagcuuc

SEQ ID NO: 399 - RNA, 1821 nt, Artificial Sequence
  Synthetic Polynucleotide
auggaaaccccugcccagcugcuguuccugcugcugcuguggcugccugauaccacaggcgugcggggagagucccucgugugcaagaaugcccugcaggaccugagcuuccuggaacaucugcugcaagugaaguacgcccccaagaccuggaaagagcaguaccugggcugggaccuggugcaguccucugugucugcccagcagaagcugcggacccaggaaaaccccucuaccagcuucugucagcaagugcuggccgacuucaucggcggccugaacgauuucgccgccggcgugaccuuuuucgccaucgagagcgccuaccugcccuacaccgugcagaaguccagcgacggccgguucuacuucguggacaucaugaccuucagcagcgagaucagagugggcgacgagcugcuggaaguggauggcgcuccugugcaggaugugcuggccacacuguacggcagcaaccacaagggcacagccgccgaagaaucugccgcccugagaacccuguucagccggauggccucucugggccacaaggugccaagcggcagaaccacccugaagaucagacggcccuuuggcaccacccgggaagugcgcgugaaguggcgcuaugugccugagggcgugggcgaccuggccacaaucgccccuucuaucagagccccccagcugcagaaauccaugcggucauucuucccaaagaaggacgacgccuuccaccgguccagcagccuguucuacagcccuauggugccccacuucugggccgagcugagaaaccacuacgccaccuccggccugaaguccggcuacaacaucggcagcaccgacggcuuucugcccgugaucggacccgugaucugggagagcgagggccuguucagagccuacaucagcagcgugaccgacggcgacggcaagagccacaaagugggcuuucugagaauccccaccuacagcuggcaggacauggaagauuucgaccccagcggcccaccccccugggaggaauuugccaagaucauccagguguucagcagcaacaccgaggcccugaucaucgaccagaccaacaacccuggcggcagcgugcuguaccuguacgcccugcugagcaugcugaccgacagaccccuggaacugcccaagcaccggaugauccugacccaggacgaggugguggacgcccuggauuggcugacccugcuggaaaacguggacaccaacguggaaagccggcuggcccugggcgacaacauggaaggcuacacaguggaucugcagguggccgaguaccugaaaagcuucggcagacaggugcugaacugcugguccaagggcgacaucgagcugagcacccccaucccccuguucggcuucgagaagauccacccccaccccagagugcaguacagcaagcccaucugcgugcugaucaacgagcaggacuucuccugcgccgacuucuucccaguggugcugaaggacaacgacagagcccugaucgugggcaccagaacagcuggcgcuggcggcuucguguucaacgugcaguuccccaaccggaccggcaucaagaccuguagccugacaggcucucuggccgugcgggaacacggcgccuucaucgagaacaucggcguggaaccccacaucgaccugccuuucaccgccaacgacauccgguacaagggcuacucugaguaccuggacaaagugaagaaacucgugugccagcugauuaacaacgacggcaccaucauccuggccgaggacggcagcuuccaccaccaccaucaccac

SEQ ID NO: 400 - RNA, 1803 nt, Artificial Sequence
  Synthetic Polynucleotide
auggaaaccccugcccagcugcuguuccugcugcugcuguggcugccugauaccacaggcgugcggggagagucccucgugugcaagaaugcccugcaggaccugagcuuccuggaacaucugcugcaagugaaguacgcccccaagaccuggaaagagcaguaccugggcugggaccuggugcaguccucugugucugcccagcagaagcugcggacccaggaaaaccccucuaccagcuucugucagcaagugcuggccgacuucaucggcggccugaacgauuuccaugccggcgugaccuuuuucgccaucgagagcgccuaccugcccuacaccgugcagaaguccagcgacggccgguucuacuucguggacaucaugaccuucagcagcgagaucagagugggcgacgagcugcuggaaguggauggcgcuccugugcaggaugugcuggccacacuguacggcagcaaccacaagggcacagccgccgaagaaucugccgcccugagaacccuguucagccggauggccucucugggccacaaggugccaagcggcagaaccacccugaagaucagacggcccuuuggcaccacccgggaagugcgcgugaaguggcgcuaugugccugagggcgugggcgaccuggccacaaucgccccuucuaucagagccccccagcugcagaaauccaugcggucauucuucccaaagaaggacgacgccuuccaccgguccagcagccuguucuacagcccuauggugccccacuucugggccgagcugagaaaccacuacgccaccuccggccugaaguccggcuacaacaucggcagcaccgacggcuuucugcccgugaucggacccgugaucugggagagcgagggccuguucagagccuacaucagcagcgugaccgacggcgacggcaagagccacaaagugggcuuucugagaauccccaccuacagcuggcaggacauggaagauuucgaccccagcggcccaccccccugggaggaauuugccaagaucauccagguguucagcagcaacaccgaggcccugaucaucgaccagaccaacaacccuggcggcagcgugcuguaccuguacgcccugcugagcaugcugaccgacagaccccuggaacugcccaagcaccggaugauccugacccaggacgaggugguggacgcccuggauuggcugacccugcuggaaaacguggacaccaacguggaaagccggcuggcccugggcgacaacauggaaggcuacacaguggaucugcagguggccgaguaccugaaaagcuucggcagacaggugcugaacugcugguccaagggcgacaucgagcugagcacccccaucccccuguucggcuucgagaagauccacccccaccccagagugcaguacagcaagcccaucugcgugcugaucaacgagcaggacuucgccugcgccgacuucuucccaguggugcugaaggacaacgacagagcccugaucgugggcaccagaacagcuggcgcuggcggcuucguguucaacgugcaguuccccaaccggaccggcaucaagaccuguagccugacaggcucucuggccgugcgggaacacggcgccuucaucgagaacaucggcguggaaccccacaucgaccugccuuucaccgccaacgacauccgguacaagggcuacucugaguaccuggacaaagugaagaaacucgugugccagcugauuaacaacgacggcaccaucauccuggccgaggacggcagcuuc

SEQ ID NO: 401 - RNA, 1821 nt, Artificial Sequence
  Synthetic Polynucleotide
auggaaaccccugcccagcugcuguuccugcugcugcuguggcugccugauaccacaggcgugcggggagagucccucgugugcaagaaugcccugcaggaccugagcuuccuggaacaucugcugcaagugaaguacgcccccaagaccuggaaagagcaguaccugggcugggaccuggugcaguccucugugucugcccagcagaagcugcggacccaggaaaaccccucuaccagcuucugucagcaagugcuggccgacuucaucggcggccugaacgauuuccaugccggcgugaccuuuuucgccaucgagagcgccuaccugcccuacaccgugcagaaguccagcgacggccgguucuacuucguggacaucaugaccuucagcagcgagaucagagugggcgacgagcugcuggaaguggauggcgcuccugugcaggaugugcuggccacacuguacggcagcaaccacaagggcacagccgccgaagaaucugccgcccugagaacccuguucagccggauggccucucugggccacaaggugccaagcggcagaaccacccugaagaucagacggcccuuuggcaccacccgggaagugcgcgugaaguggcgcuaugugccugagggcgugggcgaccuggccacaaucgccccuucuaucagagccccccagcugcagaaauccaugcggucauucuucccaaagaaggacgacgccuuccaccgguccagcagccuguucuacagcccuauggugccccacuucugggccgagcugagaaaccacuacgccaccuccggccugaaguccggcuacaacaucggcagcaccgacggcuuucugcccgugaucggacccgugaucugggagagcgagggccuguucagagccuacaucagcagcgugaccgacggcgacggcaagagccacaaagugggcuuucugagaauccccaccuacagcuggcaggacauggaagauuucgaccccagcggcccaccccccugggaggaauuugccaagaucauccagguguucagcagcaacaccgaggcccugaucaucgaccagaccaacaacccuggcggcagcgugcuguaccuguacgcccugcugagcaugcugaccgacagaccccuggaacugcccaagcaccggaugauccugacccaggacgaggugguggacgcccuggauuggcugacccugcuggaaaacguggacaccaacguggaaagccggcuggcccugggcgacaacauggaaggcuacacaguggaucugcagguggccgaguaccugaaaagcuucggcagacaggugcugaacugcugguccaagggcgacaucgagcugagcacccccaucccccuguucggcuucgagaagauccacccccaccccagagugcaguacagcaagcccaucugcgugcugaucaacgagcaggacuucgccugcgccgacuucuucccaguggugcugaaggacaacgacagagcccugaucgugggcaccagaacagcuggcgcuggcggcuucguguucaacgugcaguuccccaaccggaccggcaucaagaccuguagccugacaggcucucuggccgugcgggaacacggcgccuucaucgagaacaucggcguggaaccccacaucgaccugccuuucaccgccaacgacauccgguacaagggcuacucugaguaccuggacaaagugaagaaacucgugugccagcugauuaacaacgacggcaccaucauccuggccgaggacggcagcuuccaccaccaccaucaccac

SEQ ID NO: 402 - RNA, 1323 nt, Artificial Sequence
  Synthetic Polynucleotide
auggaaaccccugcccagcugcuguuccugcugcugcuguggcugccugacaccaccggcaugacagcaucuggcggagcuggcggccugggcucuacacagacaguggauguggccagggcccaggcugcugccgcuacacaggaugcccaggaagugaucggcagccaggaagccagcgaggccucuaugcugaagggcugcgaggaccugaucaacccugccgccgcuacccgcaucaagaagaaagaggaaaaguucgagucccuggaagccagacggaagcccaccgccgacaaggccgagaagaaguccgagagcaccgaggaaaagggcgacaccccccuggaagaucgguucaccgaggaucugagcgagguguccggcgaggacuuccggggccugaagaacagcuucgacgacgacagcagccccgaggaaauccuggacgcccugaccagcaaguucagcgaccccaccaucaaggaccuggcccuggacuaccugauccagaccgcccccagcgaccggaagcugaagucugcccugauucaggccaagcaccagcugaugagccagaacccccaggccaucgugggcggcagaaaugugcugcuggccuccgagacauucgccagcagagccaacaccagccccagcucccugcggagccuguaucugcaagugaccagcucccccagcaacugcgacaaccugagacagaugcuggcuagcuaccugcccuccgagaaaaccgccgugauggaauuccucgugaacggcaugguggccgaccugaaaagcgagggcccuagcaucccucccgccaagcugcagguguacaugaccgagcugagcaaccugcaggcccugcacagcguggacagcuuuuucgaccggaacaucggcaaccuggaaaacagccugaagcacgagggccacgcccccaucccuucucugacaaccggcaaucuggccaagaccuuccugcagcugguggaagauaaguuccccagcagcuccaaggcccagaaggcccugaacgagcucgugggcccugauaccggaccucagaccgaggugcugaaccuguucuuucgggcccugaauggcugcuccccccggaucuuuucuggcgcugagaagaagcagcagcuggccagcgugaucaccaacacccuggaugccaucaacgccgacaacgaggacuaccccaagcccggcgacuuccccagaagcagcuuuagcagcacccccccucaugccccugugccccagucugagaucccuaccagcccaaccagcacccagccuccaagcccu

SEQ ID NO: 403 - RNA, 1341 nt, Artificial Sequence
  Synthetic Polynucleotide
auggaaaccccugcccagcugcuguuccugcugcugcuguggcugccugacaccaccggcaugacagcaucuggcggagcuggcggccugggcucuacacagacaguggauguggccagggcccaggcugcugccgcuacacaggaugcccaggaagugaucggcagccaggaagccagcgaggccucuaugcugaagggcugcgaggaccugaucaacccugccgccgcuacccgcaucaagaagaaagaggaaaaguucgagucccuggaagccagacggaagcccaccgccgacaaggccgagaagaaguccgagagcaccgaggaaaagggcgacaccccccuggaagaucgguucaccgaggaucugagcgagguguccggcgaggacuuccggggccugaagaacagcuucgacgacgacagcagccccgaggaaauccuggacgcccugaccagcaaguucagcgaccccaccaucaaggaccuggcccuggacuaccugauccagaccgcccccagcgaccggaagcugaagucugcccugauucaggccaagcaccagcugaugagccagaacccccaggccaucgugggcggcagaaaugugcugcuggccuccgagacauucgccagcagagccaacaccagccccagcucccugcggagccuguaucugcaagugaccagcucccccagcaacugcgacaaccugagacagaugcuggcuagcuaccugcccuccgagaaaaccgccgugauggaauuccucgugaacggcaugguggccgaccugaaaagcgagggcccuagcaucccucccgccaagcugcagguguacaugaccgagcugagcaaccugcaggcccugcacagcguggacagcuuuuucgaccggaacaucggcaaccuggaaaacagccugaagcacgagggccacgcccccaucccuucucugacaaccggcaaucuggccaagaccuuccugcagcugguggaagauaaguuccccagcagcuccaaggcccagaaggcccugaacgagcucgugggcccugauaccggaccucagaccgaggugcugaaccuguucuuucgggcccugaauggcugcuccccccggaucuuuucuggcgcugagaagaagcagcagcuggccagcgugaucaccaacacccuggaugccaucaacgccgacaacgaggacuaccccaagcccggcgacuuccccagaagcagcuuuagcagcacccccccucaugccccugugccccagucugagaucccuaccagcccaaccagcacccagccuccaagcccucaccaccaccaucaccac

SEQ ID NO: 404 - RNA, 1323 nt, Artificial Sequence
  Synthetic Polynucleotide
auggaaaccccugcccagcugcuguuccugcugcugcuguggcugccugacaccaccggcaugacagcaucuggcggagcuggcggccugggcucuacacagacaguggauguggccagggcccaggcugcugccgcuacacaggaugcccaggaagugaucggcagccaggaagccagcgaggccucuaugcugaagggcugcgaggaccugaucaacccugccgccgcuacccgcaucaagaagaaagaggaaaaguucgagucccuggaagccagacggaagcccaccgccgacaaggccgagaagaaguccgagagcaccgaggaaaagggcgacaccccccuggaagaucgguucaccgaggaucugagcgagguguccggcgaggacuuccggggccugaagaacagcuucgacgacgacagcagccccgaggaaauccuggacgcccugaccagcaaguucagcgaccccaccaucaaggaccuggcccuggacuaccugauccagaccgcccccagcgaccggaagcugaagucugcccugauucaggccaagcaccagcugaugagccagaacccccaggccaucgugggcggcagaaaugugcugcuggccuccgagacauucgccagcagagccaacaccgcccccagcucccugcggagccuguaucugcaagugaccagcucccccagcaacugcgacaaccugagacagaugcuggcuagcuaccugcccuccgagaaaaccgccgugauggaauuccucgugaacggcaugguggccgaccugaaaagcgagggcccuagcaucccucccgccaagcugcagguguacaugaccgagcugagcaaccugcaggcccugcacagcguggacagcuuuuucgaccggaacaucggcaaccuggaaaacagccugaagcacgagggccacgcccccaucccuucucugacaaccggcaaucuggccaagaccuuccugcagcugguggaagauaaguuccccagcagcuccaaggcccagaaggcccugaacgagcucgugggcccugauaccggaccucagaccgaggugcugaaccuguucuuucgggcccugaauggcugcuccccccggaucuuuucuggcgcugagaagaagcagcagcuggccagcgugaucaccaacacccuggaugccaucaacgccgacaacgaggacuaccccaagcccggcgacuuccccagaagcagcuuuagcagcacccccccucaugccccugugccccagucugagaucccuaccagcccaaccagcacccagccuccaagcccu

SEQ ID NO: 405 - RNA, 1341 nt, Artificial Sequence
  Synthetic Polynucleotide
auggaaaccccugcccagcugcuguuccugcugcugcuguggcugccugacaccaccggcaugacagcaucuggcggagcuggcggccugggcucuacacagacaguggauguggccagggcccaggcugcugccgcuacacaggaugcccaggaagugaucggcagccaggaagccagcgaggccucuaugcugaagggcugcgaggaccugaucaacccugccgccgcuacccgcaucaagaagaaagaggaaaaguucgagucccuggaagccagacggaagcccaccgccgacaaggccgagaagaaguccgagagcaccgaggaaaagggcgacaccccccuggaagaucgguucaccgaggaucugagcgagguguccggcgaggacuuccggggccugaagaacagcuucgacgacgacagcagccccgaggaaauccuggacgcccugaccagcaaguucagcgaccccaccaucaaggaccuggcccuggacuaccugauccagaccgcccccagcgaccggaagcugaagucugcccugauucaggccaagcaccagcugaugagccagaacccccaggccaucgugggcggcagaaaugugcugcuggccuccgagacauucgccagcagagccaacaccgcccccagcucccugcggagccuguaucugcaagugaccagcucccccagcaacugcgacaaccugagacagaugcuggcuagcuaccugcccuccgagaaaaccgccgugauggaauuccucgugaacggcaugguggccgaccugaaaagcgagggcccuagcaucccucccgccaagcugcagguguacaugaccgagcugagcaaccugcaggcccugcacagcguggacagcuuuuucgaccggaacaucggcaaccuggaaaacagccugaagcacgagggccacgcccccaucccuucucugacaaccggcaaucuggccaagaccuuccugcagcugguggaagauaaguuccccagcagcuccaaggcccagaaggcccugaacgagcucgugggcccugauaccggaccucagaccgaggugcugaaccuguucuuucgggcccugaauggcugcuccccccggaucuuuucuggcgcugagaagaagcagcagcuggccagcgugaucaccaacacccuggaugccaucaacgccgacaacgaggacuaccccaagcccggcgacuuccccagaagcagcuuuagcagcacccccccucaugccccugugccccagucugagaucccuaccagcccaaccagcacccagccuccaagcccucaccaccaccaucaccac

SEQ ID NO: 406 - RNA, 1323 nt, Artificial Sequence
  Synthetic Polynucleotide
auggaaaccccugcccagcugcuguuccugcugcugcuguggcugccugacaccaccggcaugacagcaucuggcggagcuggcggccugggcucuacacagacaguggauguggccagggcccaggcugcugccgcuacacaggaugcccaggaagugaucggcagccaggaagccagcgaggccucuaugcugaagggcugcgaggaccugaucaacccugccgccgcuacccgcaucaagaagaaagaggaaaaguucgagucccuggaagccagacggaagcccaccgccgacaaggccgagaagaaguccgagagcaccgaggaaaagggcgacaccccccuggaagaucgguucaccgaggaucugagcgagguguccggcgaggacuuccggggccugaagaacagcuucgacgacgacagcagccccgaggaaauccuggacgcccugaccagcaaguucagcgaccccaccaucaaggaccuggcccuggacuaccugauccagaccgcccccagcgaccggaagcugaagucugcccugauucaggccaagcaccagcugaugagccagaacccccaggccaucgugggcggcagaaaugugcugcuggccuccgagacauucgccagcagagccaacaccgcccccagcucccugcggagccuguaucugcaagugaccagcucccccagcaacugcgacaaccugagacagaugcuggcuagcuaccugcccuccgagaaaaccgccgugauggaauuccucgugaacggcaugguggccgaccugaaaagcgagggcccuagcaucccucccgccaagcugcagguguacaugaccgagcugagcaaccugcaggcccugcacagcguggacagcuuuuucgaccggaacaucggcaaccuggaaaacagccugaagcacgagggccacgcccccaucccuucucugacaaccggcaaucugaccaagaccuuccugcagcugguggaagauaaguuccccagcagcuccaaggcccagaaggcccugaacgagcucgugggcccugauaccggaccucagaccgaggugcugaaccuguucuuucgggcccugaauggcugcuccccccggaucuuuucuggcgcugagaagaagcagcagcuggccagcgugaucaccaacacccuggaugccaucaacgccgacaacgaggacuaccccaagcccggcgacuuccccagaagcagcuuuagcagcacccccccucaugccccugugccccagucugagaucccuaccagcccaaccagcacccagccuccaagcccu

SEQ ID NO: 407 - RNA, 1341 nt, Artificial Sequence
  Synthetic Polynucleotide
auggaaaccccugcccagcugcuguuccugcugcugcuguggcugccugacaccaccggcaugacagcaucuggcggagcuggcggccugggcucuacacagacaguggauguggccagggcccaggcugcugccgcuacacaggaugcccaggaagugaucggcagccaggaagccagcgaggccucuaugcugaagggcugcgaggaccugaucaacccugccgccgcuacccgcaucaagaagaaagaggaaaaguucgagucccuggaagccagacggaagcccaccgccgacaaggccgagaagaaguccgagagcaccgaggaaaagggcgacaccccccuggaagaucgguucaccgaggaucugagcgagguguccggcgaggacuuccggggccugaagaacagcuucgacgacgacagcagccccgaggaaauccuggacgcccugaccagcaaguucagcgaccccaccaucaaggaccuggcccuggacuaccugauccagaccgcccccagcgaccggaagcugaagucugcccugauucaggccaagcaccagcugaugagccagaacccccaggccaucgugggcggcagaaaugugcugcuggccuccgagacauucgccagcagagccaacaccgcccccagcucccugcggagccuguaucugcaagugaccagcucccccagcaacugcgacaaccugagacagaugcuggcuagcuaccugcccuccgagaaaaccgccgugauggaauuccucgugaacggcaugguggccgaccugaaaagcgagggcccuagcaucccucccgccaagcugcagguguacaugaccgagcugagcaaccugcaggcccugcacagcguggacagcuuuuucgaccggaacaucggcaaccuggaaaacagccugaagcacgagggccacgcccccaucccuucucugacaaccggcaaucugaccaagaccuuccugcagcugguggaagauaaguuccccagcagcuccaaggcccagaaggcccugaacgagcucgugggcccugauaccggaccucagaccgaggugcugaaccuguucuuucgggcccugaauggcugcuccccccggaucuuuucuggcgcugagaagaagcagcagcuggccagcgugaucaccaacacccuggaugccaucaacgccgacaacgaggacuaccccaagcccggcgacuuccccagaagcagcuuuagcagcacccccccucaugccccugugccccagucugagaucccuaccagcccaaccagcacccagccuccaagcccucaccaccaccaucaccac

SEQ ID NO: 408 - RNA, 1851 nt, Artificial Sequence
  Synthetic Polynucleotide
auggaaaccccugcccagcugcuguuccugcugcugcuguggcugccugacaccaccggcaugagcaucagaggcgugggcggcaacggcaacagcagaaucccuagccacaacggcgacggcagcaacaggcggagccagaacaccaagggcaacaacaagguggaagauagagugugcagccuguacagcagccgguccaacgagaaccgcgagagcccuuaugccgugguggacguguccagcaugaucgagagcacccccaccagcggcgagacaaccagagcuaguagaggcgugcugagccgguuccagaggggccucgugcggauugcugacaaagugcggagagccgugcagugcgcuuggagcagcguguccacaagcagaagcagcgccacaagagccgccgagagcggcagcucuagcagaacagcuagaggcgccagcagcggcuacagagaguacagcccuucugccgcucggggccugcggcugauguucaccgacuuuuggcggacccgggugcugagacagaccucuccuauggccggcguguucggcaaccuggacgugaacgaggccagacugauggccgccuacaccagcgagugugccgaucaccuggaagccaaagagcuggccggaccugacggcguggcagccgcuagagaaaucgccaagagaugggagaagagagugcgggaccugcaggacaagggcgcugccagaaagcugcugaacgacccccugggcagacggacccccaacuaccagagcaagaaccccggcgaguacaccgugggcaacuccauguucuacgacggcccccagguggccaaccugcagaauguggauaccggcuucuggcuggacaugagcaaccugagcgacguggugcuguccagagagauccagaccggccugagagccagagccacccuggaagaguccaugcccaugcuggaaaaucuggaagagagauuccggcggcugcaggaaaccugcgacgccgccagaaccgagaucgaggaaagcggcuggacccgggaaagcgccuccagaauggaaggcgacgaagcccagggccccagcagagugcagcaggccuuucagagcuucgugaaugagugcaacagcaucgaguucagcuucggcuccuucggcgagcacgugcgggugcugugugccagagugucaagaggacuggccgcugccggcgaggccaucagaagaugcuucagcugcugcaagggcagcacccacagauacgcccccagagaugaccugucuccugagggcgccucucuggccgaaacccuggccagauucgccgacgacaugggcaucgaaagaggcgccgacggcaccuacgacaucccccugguggacgauuggagaaggggcgugccauccaucgagggcgagggcagcgauagcaucuacgagaucaugaugcccaucuacgaagugaugaacauggaccuggaaacccggcggagcuucgccgugcagcagggccauuaccaggaccccagagccagcgacuacgaccugccuagagccuccgauuacgaucugcccagaagccccuaccccaccccuccacugccucccagauaccagcugcagaacauggauguggaagccggcuuucgcgaggccguguacgccucuuuuguggccggcauguacaacuacgucgugacccagccccaggaacggauccccaauagccagcagguggaaggcauccugcgggacaugcugaccaacggcagccagaccuuccgggaccugaugaagcgguggaacagagagguggaccgcgagcaccaccaucaccaccac

SEQ ID NO: 409 - RNA, 1179 nt, Artificial Sequence
  Synthetic Polynucleotide
augaagaaacugcugaaguccgugcugguguucgccgcccugucuagcgcaagcucucugcaggcucugcccgugggaaauccugccgagcccagccugaugaucgacggcauucugugggagggcuucggcggcgacccuugcgauccuugugcuacuuggugcgacgccaucagcaugagagugggcuacuacggcgacuucguguucgaccgggugcugaaaaccgacgugaacaaagaauuccagaugggcgccaagcccaccaccgacaccggaaauucugccgccccuagcacccugaccgccagagagaauccugccuacggccggcacaugcaggacgccgagauguucaccaacgccgccugcauggcccugaacaucugggacagauucgacguguucugcacccugggcgccaccagcggcuaccugaaaggcaauagcgccagcuucaaccucgugggccuguucggcgacaacgagaaccagaaaaccgugaaggccgagagcgugcccaacaugagcuucgaccagagcgugguggaacuguacaccgauaccaccuucgcuuggagcgugggagccagagccgcucugugggaauguggcugugccacacugggggccagcuuccaguacgcccagagcaagcccaagguggaagaacugaacgugcugugcaaugccgccgaguucaccaucaacaagccuaagggcuacgugggcaaagaguucccccuggaucugaccgccggaaccgaugccgccaccggaacaaaggacgccagcaucgacuaccacgaguggcaggcuucucuggcccugagcuaccggcugaauauguucacccccuacaucggcgugaagugguccagagccagcuucgacgccgacaccaucagaaucgcccagcccaagagcgccaccgccaucuuugauaccaccacccugaaccccaccauugccggcgcuggcgacgugaaaacaggcgccgaaggacagcugggcgacacaaugcagaucgugucccugcagcugaacaagaugaagucccggaaguccugcggaaucgccgugggcaccacaaucguggacgccgauaaguacgccgugaccguggaaacccggcugaucgaugagagggccgcucacgugaacgcccaguucagauuc

SEQ ID NO: 410 - RNA, 2070 nt, Artificial Sequence
  Synthetic Polynucleotide
auggaaacccccgcccaacuccuguuccuucuucugcucuggcucccugacacuacuggugcugagauuaugauaccucagggaaucuacgacggagagacucugacugucucguucccguauaccgugaucggcgaccccucuggcaccaccgucuuuuccgccggggagcugacccugaaaaaccuggacaacagcaucgcggcccugccccugagcuguuucggaaacuuguuggguuccuucacugugcucggacggggucacucccugaccuuugagaauauccggacuucgacuaacggcgccgcccugucggauucagccaacuccggacucuucaccaucgaaggcuucaaggaacucagcuuuagcaauugcaacucgcugcuggcggugcugccagcggcuaccacuaacaacggaucccaaacucccaccaccacuucgacuccguccaaugggaccaucuacuccaagaccgaucuccuucuccugaacaacgagaaguucuccuucuacuccaaccugguguccggggaugggggugccauugacgccaagucacugacagugcagggcaucuccaagcucuguguguuccaagaaaacaccgcccaggccgaugggggagcgugccaggucgucaccuccuucucugcaauggccaacgaggcccccaucgccuucauugcaaacguggcgggcgugcgcggcggcggcauugccgcggugcaagacggccagcagggagugucguccucaaccucgaccgaagauccggucguguccuucucccggaauacugccguggaauucgacggaaacguggcucgcgugggaggcggaaucuacagcuauggaaacgucgccuuucugaacaacggcaaaacgcuuuuccugaacaaugucgcuagcccuguguacaucgcugccgaacagccgaccaacggacaggcauccaacaccagcgacaacuauggcgauggcggcgcgaucuucugcaagaacggggcccaggcggccgggagcaacaacucaggauccguguccuucgacggagaaggcgucguguucuucuccucaaacguggcugccggaaaggguggagccaucuacgcgaagaagcucuccguggccaauugcggaccgguccaguuccugggaaacauugccaacgacggaggugcaaucuaccugggagaaagcggagaacugucgcucuccgccgacuacggcgauaucaucuucgacggcaaccucaagcggaccgcaaaggagaacgcggcagacgucaauggagugaccgugucgagccaagccauuucaauggguuccggcgggaagaucaccaccuugagggccaaggccggccaccagauucuguucaacgauccuauugagauggccaacgggaacaaccagccugcgcaguccucggaaccccugaagaucaaugacggagagggcuacacuggagacaucguguucgccaacggaaacuccaccuuguaccagaacgugacgauugagcaggggagaauugugcugagagaaaaagcgaagcuguccgugaauagcuugagccagaccgggggcucacuguacauggaggccggauccacccuggacuucgugacaccgcagccaccgcagcagccucccgccgcgaaccaacugauuacccucucgaaccuucaccugagccuguccucacugcuggcaaacaacgcugugacuaacccuccaaccaacccgccggcccaggacagccauccggccauuaucggcuccaccaccgccgguucugugaccaucagcggcccaaucuuuuucgaggaucuggacgacaccgcuuacgaccgcuacgauuggcugggauccaaccagaagaucgacgugcuuaagcugcaacugggaacgcaacccuccgccaacgccccgucggaccugacccuggggaacgaaaugccuaaguacggauaccaggggagcuggaagcucgccugggaucccaacaccgccaacaacgguccguacacucugaaggccaccuggacuaagacuggu

SEQ ID NO: 411 - RNA, 2088 nt, Artificial Sequence
  Synthetic Polynucleotide
auggaaacccccgcccaacuccuguuccuucuucugcucuggcucccugacacuacuggugcugagauuaugauaccucagggaaucuacgacggagagacucugacugucucguucccguauaccgugaucggcgaccccucuggcaccaccgucuuuuccgccggggagcugacccugaaaaaccuggacaacagcaucgcggcccugccccugagcuguuucggaaacuuguuggguuccuucacugugcucggacggggucacucccugaccuuugagaauauccggacuucgacuaacggcgccgcccugucggauucagccaacuccggacucuucaccaucgaaggcuucaaggaacucagcuuuagcaauugcaacucgcugcuggcggugcugccagcggcuaccacuaacaacggaucccaaacucccaccaccacuucgacuccguccaaugggaccaucuacuccaagaccgaucuccuucuccugaacaacgagaaguucuccuucuacuccaaccugguguccggggaugggggugccauugacgccaagucacugacagugcagggcaucuccaagcucuguguguuccaagaaaacaccgcccaggccgaugggggagcgugccaggucgucaccuccuucucugcaauggccaacgaggcccccaucgccuucauugcaaacguggcgggcgugcgcggcggcggcauugccgcggugcaagacggccagcagggagugucguccucaaccucgaccgaagauccggucguguccuucucccggaauacugccguggaauucgacggaaacguggcucgcgugggaggcggaaucuacagcuauggaaacgucgccuuucugaacaacggcaaaacgcuuuuccugaacaaugucgcuagcccuguguacaucgcugccgaacagccgaccaacggacaggcauccaacaccagcgacaacuauggcgauggcggcgcgaucuucugcaagaacggggcccaggcggccgggagcaacaacucaggauccguguccuucgacggagaaggcgucguguucuucuccucaaacguggcugccggaaaggguggagccaucuacgcgaagaagcucuccguggccaauugcggaccgguccaguuccugggaaacauugccaacgacggaggugcaaucuaccugggagaaagcggagaacugucgcucuccgccgacuacggcgauaucaucuucgacggcaaccucaagcggaccgcaaaggagaacgcggcagacgucaauggagugaccgugucgagccaagccauuucaauggguuccggcgggaagaucaccaccuugagggccaaggccggccaccagauucuguucaacgauccuauugagauggccaacgggaacaaccagccugcgcaguccucggaaccccugaagaucaaugacggagagggcuacacuggagacaucguguucgccaacggaaacuccaccuuguaccagaacgugacgauugagcaggggagaauugugcugagagaaaaagcgaagcuguccgugaauagcuugagccagaccgggggcucacuguacauggaggccggauccacccuggacuucgugacaccgcagccaccgcagcagccucccgccgcgaaccaacugauuacccucucgaaccuucaccugagccuguccucacugcuggcaaacaacgcugugacuaacccuccaaccaacccgccggcccaggacagccauccggccauuaucggcuccaccaccgccgguucugugaccaucagcggcccaaucuuuuucgaggaucuggacgacaccgcuuacgaccgcuacgauuggcugggauccaaccagaagaucgacgugcuuaagcugcaacugggaacgcaacccuccgccaacgccccgucggaccugacccuggggaacgaaaugccuaaguacggauaccaggggagcuggaagcucgccugggaucccaacaccgccaacaacgguccguacacucugaaggccaccuggacuaagacuggucaccaucaucaccaccac

SEQ ID NO: 412 - RNA, 2067 nt, Artificial Sequence
  Synthetic Polynucleotide
auggaaaccccugcccaacuucuguuccuccuucugcucuggcuccccgacacuaccggugcugagaucaugauuccgcaaggcaucuacgacggggaaacucugaccguguccuuuccauacaccgucauuggugauccuuccggaacuaccguguucuccgcgggcgaacugaccuugaagaaucuugacaauuccaucgcggcccugccccugagcugcuucggcaacuugcugggaucguucacugugcuggggcgcggacauucgcugacuuucgaaaacauuagaaccagcaccaacggugcugcgcuuucgaauagcgccgcugauggcuuguucaccaucgaggguuucaaggaacugagcuucuccaacugcaacucgcugcucgccgugcugccggccgcuacuacgaacaagggcagccagacuccgacgacaaccuccacucccucaaacggcaccaucuacuccaagaccgaucugcugcugcucaacaacgagaaguucucauucuacuccaaccucguguccggcgacggaggcgcaauugacgccaagagccugaccgugcagggaaucucaaagcugugcgucuuucaagagaacacugcgcaggcagacggaggagccugucaggucgugaccuccuuuuccgccauggccaacgaggccccuaucgccuucguggccaacguggccggcgugcgggguggaggaaucgcagccgugcaagacggccagcagggagugucuagcagcacuuccaccgaggaccccguggugucguucucccggaacaccgccguggaguucgauggaaacguggcgcgcguggggggaggcaucuacuccuacgggaacgucgccuuucuuaacaacggaaagacccuguuccugaacaauguggccucgccgguguacaucgccgccaagcagccaacuagcggccaggccuccaacaccuccaacaacuauggcgacggcggagccaucuucugcaagaacggcgcucaagcuggaucgaacaacagcgguucugucuccuucgacggcgaaggagucguguuuuucuccuccaacgucgcggccggcaaagggggggccauauacgcgaagaaacugucaguggcgaacugcggacccgugcaguuccuccggaacauugccaacgacgggggugcaaucuaccugggagagucaggagaacugagccucucggcggauuacggcgacaucauuuucgacggaaaucugaagcggaccgccaaggaaaacgcggcagaugugaacggggucaccgugucaagccaggccauuucuaugggguccggagggaagauuaccacccugcgcgccaaggccggccaucagauucucuucaacgacccuaucgagauggcuaauggaaacaaucagcccgcccaguccuccaagcugcugaaaaucaacgacggagagggguacaccggggauaucguguucgccaacggaagcucgacucucuaccaaaacgugaccauugagcaggggaggaucgugcugagggaaaaggcuaagcuguccgucaacucgcugagccagaccggaggcucccucuacauggaagcaggaucgacgcuggacuucgugacuccgcaaccaccgcagcagccucccgccgccaaccagcugaucaccuuguccaaucugcaccugagccugucguccuugcucgccaacaacgccgugacuaacccuccuacuaacccgccggcccaggacucgcacccggccgucaucggaucaaccacagcaggaagcgugacuaucuccgguccuaucuucuucgaggaccuggaugacaccgccuacgauagauacgauugguuggguuccaaccagaagauuaacgugcugaagcugcagcugggaaccaagccaccggcgaacgccccguccgaccugacccucggcaacgaaaugcccaaauacggauaccagggcuccuggaagcucgcgugggaccccaauaccgcgaacaacggucccuauacacucaaggccacuuggaccaagaccggc

SEQ ID NO: 413 - RNA, 2085 nt, Artificial Sequence
  Synthetic Polynucleotide
auggaaaccccugcccaacuucuguuccuccuucugcucuggcuccccgacacuaccggugcugagaucaugauuccgcaaggcaucuacgacggggaaacucugaccguguccuuuccauacaccgucauuggugauccuuccggaacuaccguguucuccgcgggcgaacugaccuugaagaaucuugacaauuccaucgcggcccugccccugagcugcuucggcaacuugcugggaucguucacugugcuggggcgcggacauucgcugacuuucgaaaacauuagaaccagcaccaacggugcugcgcuuucgaauagcgccgcugauggcuuguucaccaucgaggguuucaaggaacugagcuucuccaacugcaacucgcugcucgccgugcugccggccgcuacuacgaacaagggcagccagacuccgacgacaaccuccacucccucaaacggcaccaucuacuccaagaccgaucugcugcugcucaacaacgagaaguucucauucuacuccaaccucguguccggcgacggaggcgcaauugacgccaagagccugaccgugcagggaaucucaaagcugugcgucuuucaagagaacacugcgcaggcagacggaggagccugucaggucgugaccuccuuuuccgccauggccaacgaggccccuaucgccuucguggccaacguggccggcgugcgggguggaggaaucgcagccgugcaagacggccagcagggagugucuagcagcacuuccaccgaggaccccguggugucguucucccggaacaccgccguggaguucgauggaaacguggcgcgcguggggggaggcaucuacuccuacgggaacgucgccuuucuuaacaacggaaagacccuguuccugaacaauguggccucgccgguguacaucgccgccaagcagccaacuagcggccaggccuccaacaccuccaacaacuauggcgacggcggagccaucuucugcaagaacggcgcucaagcuggaucgaacaacagcgguucugucuccuucgacggcgaaggagucguguuuuucuccuccaacgucgcggccggcaaagggggggccauauacgcgaagaaacugucaguggcgaacugcggacccgugcaguuccuccggaacauugccaacgacgggggugcaaucuaccugggagagucaggagaacugagccucucggcggauuacggcgacaucauuuucgacggaaaucugaagcggaccgccaaggaaaacgcggcagaugugaacggggucaccgugucaagccaggccauuucuaugggguccggagggaagauuaccacccugcgcgccaaggccggccaucagauucucuucaacgacccuaucgagauggcuaauggaaacaaucagcccgcccaguccuccaagcugcugaaaaucaacgacggagagggguacaccggggauaucguguucgccaacggaagcucgacucucuaccaaaacgugaccauugagcaggggaggaucgugcugagggaaaaggcuaagcuguccgucaacucgcugagccagaccggaggcucccucuacauggaagcaggaucgacgcuggacuucgugacuccgcaaccaccgcagcagccucccgccgccaaccagcugaucaccuuguccaaucugcaccugagccugucguccuugcucgccaacaacgccgugacuaacccuccuacuaacccgccggcccaggacucgcacccggccgucaucggaucaaccacagcaggaagcgugacuaucuccgguccuaucuucuucgaggaccuggaugacaccgccuacgauagauacgauugguuggguuccaaccagaagauuaacgugcugaagcugcagcugggaaccaagccaccggcgaacgccccguccgaccugacccucggcaacgaaaugcccaaauacggauaccagggcuccuggaagcucgcgugggaccccaauaccgcgaacaacggucccuauacacucaaggccacuuggaccaagaccggccaccaccaucaccaccac

SEQ ID NO: 414 - RNA, 3579 nt, Artificial Sequence
  Synthetic Polynucleotide
auggaaacuccugcccaacuguuguuccuucugcugcucugguugcccgacaccaccggaucgugcguggaucuccacgcuggcggccaguccgugaacgagcuuguguacgugggcccacaggccgugcuucugcuggaccagaucagagaucucuucguggguuccaaggacucccaggccgagggacaguaccggcucaucgucggcgacccuucaagcuuccaagagaaggaugccgacacucuuccggggaagguggaacaguccacucuguuuuccgugaccaacccagucguguuucaagggguggaccagcaggaccagguguccagccaaggacugaucuguucauucaccucgagcaauuuggacagcccccgggacggcgaaucguuccuuggcaucgcauucgugggagacucauccaaagcaggaaucacccuuaccgaugugaaggcgucccugagcggcgcugcucuguacuccaccgaagaucucaucuucgagaagaucaaggguggacuggaguucgccagcugcuccucacuggaacagggaggagccugugccgcccaaagcauccucauccacgauugccaggggcuccaagugaagcauuguaccacugccgugaacgccgagggaucauccgcuaacgaucaccucgguuucggagggggugccuucuucgugaccgguucgcugucgggagaaaagucacuguauaugcccgcgggcgacaugguggucgccaacugcgauggagccaucucauucgagggaaacuccgccaacuucgcaaacggcggcgcuaucgccgcuagcgggaaggugcuguucguggcuaacgacaagaaaacguccuucaucgaaaaccgcgcccugucgggaggugccauugccgccagcuccgacauugccuuccaaaacugugcggaacugguguucaaaggaaacugcgccaucggcaccgaagauaagggaagccugggggggggcgccauuuccucccucggcaccgugcugcuucagggaaaccacggcaucacuugugacaagaacgaaagcgcgucccaggggggagcgaucuucgggaaaaacugccagauuuccgacaacgagggaccggugguguucagagacuccacugccugccugggcggcggagcgaucgcagcacaggaaauugucagcauccagaacaaccaggccggcaucagcuucgaggggggaaaggcuucguucggcggagguauugccugcggaucguucucguccgcgggcggagccuccgugcucggaaccaucgacauuuccaagaaccugggcgcuaucucguuuucucgcacccugugcacuacuuccgaccugggucagauggaguaccagggaggcggagcgcuguuuggagagaacaucucucugagcgagaacgcgggagugcugaccuucaaggacaacauugugaaaaccuucgccucaaacggaaagauccuggggggaggcgccauccuggcaaccgggaaggucgaaaucaccaacaauucagaggguaucuccuucacuggcaacgcccgggccccccaagcccugccgacucaggaagaguucccccuguucuccaagaaggaaggacgcccuuugucauccggcuacuccggugguggagcgauucugggucgggaaguggccauccugcauaaugcggccgugguguuugagcaaaacagacuccaaugcuccgaagaagaggccacccuccuggggugcugcgggggcggagcagugcauggcauggauuccacuuccaucgugggaaacuccagcguccgcuucggaaacaacuacgcuaugggacagggagugucagggggggcccugcuguccaagaccguccaguuggccggaaacgguucgguggauuucucacgcaauaucgccucgcugggaggcggcgcgcugcaggccuccgaaggaaauugcgaacuggucgacaacggcuacgugcuguuccgggacaaccgcggcaggguguacggcggagcaaucucgugccuucggggcgacgucgugaucucgggaaauaagggacgggucgaguuuaaggacaacaucgcuaccaggcucuacguggaggaaacuguggagaagguggaggaaguggagccugccccggaacagaaggacaacaacgagcugucguuccucggucgggcagaacaguccuucauuacugccgccaaccaggcccuguucgcguccgaagauggugaccucagcccggaauccagcaucuccuccgaggaacuggccaagcggagagaaugcgcgggaggcgcaaucuuugcgaagcggguccggaucguggacaaccaggaagcugugguguucagcaacaacuuuuccgacaucuacgguggugcaauuuucaccggcucacuccgggaggaggacaagcuggacggccagauucccgaggugcucauuuccggcaaugccggcgacgugguguucuccggaaacuccuccaagagggacgaacaccucccgcauaccggaggaggagccaucugcacucagaaccugacgaucucgcagaacaccggcaaugugcuguucuacaacaacgucgcauguuccgguggcgccgucagaaucgaggaccacggaaacgugcugcuggaagcauucgggggugauauuguguucaagggaaacagcagcuuccgggcccagggaucagaugcaaucuacuucgccgggaaggagagccacauuaccgcccugaacgccaccgagggucacgccaucguguuccacgaugcccugguguucgaaaaccuggaggagcgcaagagcgccgaagugcugcuuaucaauucccgcgaaaacccgggcuacaccggauccauccgguuccucgaagcggagucgaaggucccgcaguguauucaugugcaacaggggucccuggaacugcuuaacggagccacccugugcuccuacggcuuuaagcaggacgcgggcgcuaaacuggugcuggcggccggcgccaagcuuaagauccucgacuccggaaccccggugcagcaggggcacgcuauuagcaagccugaagccgagauugagucgucauccgaacccgaaggggcgcacucccuguggauagccaagaacgcgcagaccaccgugccaauggucgauauccacacaaucuccguggaccucgccagcuucucgucgagccagcaggagggaacugucgaagcgccucaggucaucgugccgggagguuccuacgugcgcucgggggagcucaaccuggaacucgugaauaccacuggaacgggauaugagaaccacgcccugcugaagaacgaagccaaagugccacugauguccuucgucgccuccggcgacgaggccuccgccgagauuagcaaccugucggugucagaucugcaaauucacguggugaccccugagauugaggaggacaccuacgggcacaugggcgauugguccgaggcgaagauccaggacggcacacuggucauuucauggaacccuaccgga

SEQ ID NO: 415 - RNA, 3597 nt, Artificial Sequence
  Synthetic Polynucleotide
auggaaacuccugcccaacuguuguuccuucugcugcucugguugcccgacaccaccggaucgugcguggaucuccacgcuggcggccaguccgugaacgagcuuguguacgugggcccacaggccgugcuucugcuggaccagaucagagaucucuucguggguuccaaggacucccaggccgagggacaguaccggcucaucgucggcgacccuucaagcuuccaagagaaggaugccgacacucuuccggggaagguggaacaguccacucuguuuuccgugaccaacccagucguguuucaagggguggaccagcaggaccagguguccagccaaggacugaucuguucauucaccucgagcaauuuggacagcccccgggacggcgaaucguuccuuggcaucgcauucgugggagacucauccaaagcaggaaucacccuuaccgaugugaaggcgucccugagcggcgcugcucuguacuccaccgaagaucucaucuucgagaagaucaaggguggacuggaguucgccagcugcuccucacuggaacagggaggagccugugccgcccaaagcauccucauccacgauugccaggggcuccaagugaagcauuguaccacugccgugaacgccgagggaucauccgcuaacgaucaccucgguuucggagggggugccuucuucgugaccgguucgcugucgggagaaaagucacuguauaugcccgcgggcgacaugguggucgccaacugcgauggagccaucucauucgagggaaacuccgccaacuucgcaaacggcggcgcuaucgccgcuagcgggaaggugcuguucguggcuaacgacaagaaaacguccuucaucgaaaaccgcgcccugucgggaggugccauugccgccagcuccgacauugccuuccaaaacugugcggaacugguguucaaaggaaacugcgccaucggcaccgaagauaagggaagccugggggggggcgccauuuccucccucggcaccgugcugcuucagggaaaccacggcaucacuugugacaagaacgaaagcgcgucccaggggggagcgaucuucgggaaaaacugccagauuuccgacaacgagggaccggugguguucagagacuccacugccugccugggcggcggagcgaucgcagcacaggaaauugucagcauccagaacaaccaggccggcaucagcuucgaggggggaaaggcuucguucggcggagguauugccugcggaucguucucguccgcgggcggagccuccgugcucggaaccaucgacauuuccaagaaccugggcgcuaucucguuuucucgcacccugugcacuacuuccgaccugggucagauggaguaccagggaggcggagcgcuguuuggagagaacaucucucugagcgagaacgcgggagugcugaccuucaaggacaacauugugaaaaccuucgccucaaacggaaagauccuggggggaggcgccauccuggcaaccgggaaggucgaaaucaccaacaauucagaggguaucuccuucacuggcaacgcccgggccccccaagcccugccgacucaggaagaguucccccuguucuccaagaaggaaggacgcccuuugucauccggcuacuccggugguggagcgauucugggucgggaaguggccauccugcauaaugcggccgugguguuugagcaaaacagacuccaaugcuccgaagaagaggccacccuccuggggugcugcgggggcggagcagugcauggcauggauuccacuuccaucgugggaaacuccagcguccgcuucggaaacaacuacgcuaugggacagggagugucagggggggcccugcuguccaagaccguccaguuggccggaaacgguucgguggauuucucacgcaauaucgccucgcugggaggcggcgcgcugcaggccuccgaaggaaauugcgaacuggucgacaacggcuacgugcuguuccgggacaaccgcggcaggguguacggcggagcaaucucgugccuucggggcgacgucgugaucucgggaaauaagggacgggucgaguuuaaggacaacaucgcuaccaggcucuacguggaggaaacuguggagaagguggaggaaguggagccugccccggaacagaaggacaacaacgagcugucguuccucgguagagccgaacaguccuucauuacugccgccaaccaggcccuguucgcguccgaagauggugaccucagcccggaauccagcaucuccuccgaggaacuggccaagcggagagaaugcgcgggaggcgcaaucuuugcgaagcggguccggaucguggacaaccaggaagcugugguguucagcaacaacuuuuccgacaucuacgguggugcaauuuucaccggcucacuccgggaggaggacaagcuggacggccagauucccgaggugcucauuuccggcaaugccggcgacgugguguucuccggaaacuccuccaagagggacgaacaccucccgcauaccggaggaggagccaucugcacucagaaccugacgaucucgcagaacaccggcaaugugcuguucuacaacaacgucgcauguuccgguggcgccgucagaaucgaggaccacggaaacgugcugcuggaagcauucgggggugauauuguguucaagggaaacagcagcuuccgggcccagggaucagaugcaaucuacuucgccgggaaggagagccacauuaccgcccugaacgccaccgagggucacgccaucguguuccacgaugcccugguguucgaaaaccuggaggagcgcaagagcgccgaagugcugcuuaucaauucccgcgaaaacccgggcuacaccggauccauccgguuccucgaagcggagucgaaggucccgcaguguauucaugugcaacaggggucccuggaacugcuuaacggagccacccugugcuccuacggcuuuaagcaggacgcgggcgcuaaacuggugcuggcggccggcgccaagcuuaagauccucgacuccggaaccccggugcagcaggggcacgcuauuagcaagccugaagccgagauugagucgucauccgaacccgaaggggcgcacucccuguggauagccaagaacgcgcagaccaccgugccaauggucgauauccacacaaucuccguggaccucgccagcuucucgucgagccagcaggagggaacugucgaagcgccucaggucaucgugccgggagguuccuacgugcgcucgggggagcucaaccuggaacucgugaauaccacuggaacgggauaugagaaccacgcccugcugaagaacgaagccaaagugccacugauguccuucgucgccuccggggacgaggccuccgccgagauuagcaaccugucggugucagaucugcaaauucacguggucaccccugagauugaggaggacaccuacgggcacaugggcgauugguccgaggcgaagauccaggacggcacacuggucauuucauggaacccuaccggacaucaccaccaccaucac

SEQ ID NO: 416 - RNA, 3576 nt, Artificial Sequence
  Synthetic Polynucleotide
auggaaacuccugcccaacuguuguuccuucugcugcucugguugcccgacaccaccggaucgugcguggaucuccacgcuggcggccaguccgugaacgagcuuguguacgugggcccacaggccgugcuucugcuggaccagaucagagaucucuucguggguuccaaggacucccaggccgagggacaguaccggcucaucgucggcgacccuucaagcuuccaagagaaggaugccgacacucuuccggggaagguggaacaguccacucuguuuuccgugaccaacccagucguguuucaagggguggaccagcaggaccagguguccagccaaggacugaucuguucauucaccucgagcaauuuggacagcccccgggacggcgaaucguuccuuggcaucgcauucgugggagacucauccaaagcaggaaucacccuuaccgaugugaaggcgucccugagcggcgcugcucuguacuccaccgaagaucucaucuucgagaagaucaaggguggacuggaguucgccagcugcuccucacuggaacagggaggagccugugccgcccaaagcauccucauccacgauugccaggggcuccaagugaagcauuguaccacugccgugaacgccgagggaucauccgcuaacgaucaccucgguuucggagggggugccuucuucgugaccgguucgcugucgggagaaaagucacuguauaugcccgcgggcgacaugguggucgccaacugcgauggagccaucucauucgagggaaacuccgccaacuucgcaaacggcggcgcuaucgccgcuagcgggaaggugcuguucguggcuaacgacaagaaaacguccuucaucgaaaaccgcgcccugucgggaggugccauugccgccagcuccgacauugccuuccaaaacugugcggaacugguguucaaaggaaacugcgccaucggcaccgaagauaagggaagccugggggggggcgccauuuccucccucggcaccgugcugcuucagggaaaccacggcaucacuugugacaagaacgaaagcgcgucccaggggggagcgaucuucgggaaaaacugccagauuuccgacaacgagggaccggugguguucagagacuccacugccugccugggcggcggagcgaucgcagcacaggaaauugucagcauccagaacaaccaggccggcaucagcuucgaggggggaaaggcuucguucggcggagguauugccugcggaucguucucguccgcgggcggagccuccgugcucggaaccaucgacauuuccaagaaccugggcgcuaucucguuuucucgcacccugugcacuacuuccgaccugggucagauggaguaccagggaggcggagcgcuguuuggagagaacaucucucugagcgagaacgcgggagugcugaccuucaaggacaacauugugaaaaccuucgccucaaacggaaagauccuggggggaggcgccauccuggcaaccgggaaggucgaaaucaccaacaauucaggcgguaucuccuucacuggcaacgcccgggccccccaagcccugccgacucaggaagaguucccccuguucuccaagaaggaaggacgcccuuugucauccggcuacuccggugguggagcgauucugggucgggaaguggccauccugcauaaugcggccgugguguuugagcaaaacagacuccaaugcuccgaagaagaggccacccuccuggggugcugcgggggcggagcagugcauggcauggauuccacuuccaucgugggaaacuccagcguccgcuucggaaacaacuacgcuaugggacagggagugucagggggggcccugcuguccaagaccguccaguuggccggaaacgguucgguggauuucucacgcaauaucgccucgcugggaggcggcgcgcugcaggccuccgaaggaaauugcgaacuggucgacaacggcuacgugcuguuccgggacaaccgcggcaggguguacggcggagcaaucucgugccuucggggcgacgucgugaucucgggaaauaagggacgggucgaguuuaaggacaacaucgcuaccaggcucuacguggaggaaacuguggagaagguggaggaaguggagccugccccggaacagaaggacaacaacgagcugucguuccucgguuccgucgaacaguccuucauuacugccgccaaccaggcccuguucgcguccgaagauggugaccucagcccggaauccagcaucuccuccgaggaacuggccaagcggagagaaugcgcgggaggcgcaaucuuugcgaagcggguccggaucguggacaaccaggaagcugugguguucagcaacaacuuuuccgacaucuacgguggugcaauuuucaccggcucacuccgggaggaggacaagcuggacggccagauucccgaggugcucauuuccggcaaugccggcgacgugguguucuccggaaacuccuccaagagggacgaacaccucccgcauaccggaggaggagccaucugcacucagaaccugacgaucucgcagaacaccggcaaugugcuguucuacaacaacgucgcauguuccgguggcgccgucagaaucgaggaccacggaaacgugcugcuggaagcauucgggggugauauuguguucaagggaaacagcagcuuccgggcccagggaucagaugcaaucuacuucgccgggaaggagagccacauuaccgcccugaacgccaccgagggucacgccaucguguuccacgaugcccugguguucgaaaaccugaaggagcgcaagagcgccgaagugcugcuuaucaauucccgcgaaaacccgggcuacaccggauccauccgguuccucgaagcggagucgaaggucccgcaguguauucaugugcaacaggggucccuggaacugcuuaacggagccacccugugcuccuacggcuuuaagcaggacgcgggcgcuaaacuggugcuggcggccggcuccaagcuuaagauccucgacuccggaaccccggugcaggggcacgcuauuagcaagccugaagccgagauugagucgucauccgaacccgaaggggcgcacucccuguggauagccaagaacgcgcagaccaccgugccaauggucgauauccacacaaucuccguggaccucgccagcuucucgucgagccagcaggagggaacugucgaagcgccucaggucaucgugccgggagguuccuacgugcgcucgggggagcucaaccuggaacucgugaauaccacuggaacgggauaugagaaccacgcccugcugaagaacgaagccaaagugccacugauguccuucgucgccuccuccgacgaggccuccgccgagauuagcaaccugucggugucagaucugcaaauucacguggccaccccugagauugaggaggacaccuacgggcacaugggcgauugguccgaggcgaagauccaggacggcacacuggucauuucauggaacccuaccgga

SEQ ID NO: 417 - RNA, 3594 nt, Artificial Sequence
  Synthetic Polynucleotide
auggaaacuccugcccaacuguuguuccuucugcugcucugguugcccgacaccaccggaucgugcguggaucuccacgcuggcggccaguccgugaacgagcuuguguacgugggcccacaggccgugcuucugcuggaccagaucagagaucucuucguggguuccaaggacucccaggccgagggacaguaccggcucaucgucggcgacccuucaagcuuccaagagaaggaugccgacacucuuccggggaagguggaacaguccacucuguuuuccgugaccaacccagucguguuucaagggguggaccagcaggaccagguguccagccaaggacugaucuguucauucaccucgagcaauuuggacagcccccgggacggcgaaucguuccuuggcaucgcauucgugggagacucauccaaagcaggaaucacccuuaccgaugugaaggcgucccugagcggcgcugcucuguacuccaccgaagaucucaucuucgagaagaucaaggguggacuggaguucgccagcugcuccucacuggaacagggaggagccugugccgcccaaagcauccucauccacgauugccaggggcuccaagugaagcauuguaccacugccgugaacgccgagggaucauccgcuaacgaucaccucgguuucggagggggugccuucuucgugaccgguucgcugucgggagaaaagucacuguauaugcccgcgggcgacaugguggucgccaacugcgauggagccaucucauucgagggaaacuccgccaacuucgcaaacggcggcgcuaucgccgcuagcgggaaggugcuguucguggcuaacgacaagaaaacguccuucaucgaaaaccgcgcccugucgggaggugccauugccgccagcuccgacauugccuuccaaaacugugcggaacugguguucaaaggaaacugcgccaucggcaccgaagauaagggaagccugggggggggcgccauuuccucccucggcaccgugcugcuucagggaaaccacggcaucacuugugacaagaacgaaagcgcgucccaggggggagcgaucuucgggaaaaacugccagauuuccgacaacgagggaccggugguguucagagacuccacugccugccugggcggcggagcgaucgcagcacaggaaauugucagcauccagaacaaccaggccggcaucagcuucgaggggggaaaggcuucguucggcggagguauugccugcggaucguucucguccgcgggcggagccuccgugcucggaaccaucgacauuuccaagaaccugggcgcuaucucguuuucucgcacccugugcacuacuuccgaccugggucagauggaguaccagggaggcggagcgcuguuuggagagaacaucucucugagcgagaacgcgggagugcugaccuucaaggacaacauugugaaaaccuucgccucaaacggaaagauccuggggggaggcgccauccuggcaaccgggaaggucgaaaucaccaacaauucaggcgguaucuccuucacuggcaacgcccgggccccccaagcccugccgacucaggaagaguucccccuguucuccaagaaggaaggacgcccuuugucauccggcuacuccggugguggagcgauucugggucgggaaguggccauccugcauaaugcggccgugguguuugagcaaaacagacuccaaugcuccgaagaagaggccacccuccuggggugcugcgggggcggagcagugcauggcauggauuccacuuccaucgugggaaacuccagcguccgcuucggaaacaacuacgcuaugggacagggagugucagggggggcccugcuguccaagaccguccaguuggccggaaacgguucgguggauuucucacgcaauaucgccucgcugggaggcggcgcgcugcaggccuccgaaggaaauugcgaacuggucgacaacggcuacgugcuguuccgggacaaccgcggcaggguguacggcggagcaaucucgugccuucggggcgacgucgugaucucgggaaauaagggacgggucgaguuuaaggacaacaucgcuaccaggcucuacguggaggaaacuguggagaagguggaggaaguggagccugccccggaacagaaggacaacaacgagcugucguuccucgguuccgucgaacaguccuucauuacugccgccaaccaggcccuguucgcguccgaagauggugaccucagcccggaauccagcaucuccuccgaggaacuggccaagcggagagaaugcgcgggaggcgcaaucuuugcgaagcggguccggaucguggacaaccaggaagcugugguguucagcaacaacuuuuccgacaucuacgguggugcaauuuucaccggcucacuccgggaggaggacaagcuggacggccagauucccgaggugcucauuuccggcaaugccggcgacgugguguucuccggaaacuccuccaagagggacgaacaccucccgcauaccggaggaggagccaucugcacucagaaccugacgaucucgcagaacaccggcaaugugcuguucuacaacaacgucgcauguuccgguggcgccgucagaaucgaggaccacggaaacgugcugcuggaagcauucgggggugauauuguguucaagggaaacagcagcuuccgggcccagggaucagaugcaaucuacuucgccgggaaggagagccacauuaccgcccugaacgccaccgagggucacgccaucguguuccacgaugcccugguguucgaaaaccugaaggagcgcaagagcgccgaagugcugcuuaucaauucccgcgaaaacccgggcuacaccggauccauccgguuccucgaagcggagucgaaggucccgcaguguauucaugugcaacaggggucccuggaacugcuuaacggagccacccugugcuccuacggcuuuaagcaggacgcgggcgcuaaacuggugcuggcggccggcuccaagcuuaagauccucgacuccggaaccccggugcaggggcacgcuauuagcaagccugaagccgagauugagucgucauccgaacccgaaggggcgcacucccuguggauagccaagaacgcgcagaccaccgugccaauggucgauauccacacaaucuccguggaccucgccagcuucucgucgagccagcaggagggaacugucgaagcgccucaggucaucgugccgggagguuccuacgugcgcucgggggagcucaaccuggaacucgugaauaccacuggaacgggauaugagaaccacgcccugcugaagaacgaagccaaagugccacugauguccuucgucgccuccuccgacgaggccuccgccgagauuagcaaccugucggugucagaucugcaaauucacguggccaccccugagauugaggaggacaccuacgggcacaugggcgauugguccgaggcgaagauccaggacggcacacuggucauuucauggaacccuaccggacaucaccaccaccaucac

SEQ ID NO: 418 - RNA, 318 nt, Artificial Sequence
  Synthetic Polynucleotide
auggaaacuccugcccaacuccuguucuugcugcugcuuuggcucccugacacuaccggaaugagccagaacaagaacucggcauucaugcagccggucaauguguccgccgaucuggccgccauugugggagcugggcccaugccacggaccgaaaucaucaaaaagaugugggacuacauuaagaagaacggccugcaggacccgaccaacaagcgcaacaucaacccggacgauaagcuggcgaagguguucgguaccgagaagcccaucgacauguuucaaaugaccaagauggugucccagcacaucauuaag

SEQ ID NO: 419 - RNA, 336 nt, Artificial Sequence
  Synthetic Polynucleotide
auggaaacuccugcccaacuccuguucuugcugcugcuuuggcucccugacacuaccggaaugagccagaacaagaacucggcauucaugcagccggucaauguguccgccgaucuggccgccauugugggagcugggcccaugccacggaccgaaaucaucaaaaagaugugggacuacauuaagaagaacggccugcaggacccgaccaacaagcgcaacaucaacccggacgauaagcuggcgaagguguucgguaccgagaagcccaucgacauguuucaaaugaccaagauggugucccagcacaucauuaagcaccaccaccaucaccau

SEQ ID NO: 420 - RNA, 318 nt, Artificial Sequence
  Synthetic Polynucleotide
auggaaacuccugcccaacuguuguuccugcugcuucucuggcucccugacacuaccggaaugucgcagaacaagaacuccgccuucaugcaacccgugaacgugucagcggaccuggcagcuauugucggugccgggccgaugccccgcaccgaaaucaucaagaagaugugggacuacaucaaggagaacagccugcaggauccaaccaacaagcggaauaucaacccggacgauaagcuggccaaaguguucggcaccgagaagccgauugacauguuucagaugaccaagauggugucccagcacaucauuaag

SEQ ID NO: 421 - RNA, 336 nt, Artificial Sequence
  Synthetic Polynucleotide
auggaaacuccugcccaacuguuguuccugcugcuucucuggcucccugacacuaccggaaugucgcagaacaagaacuccgccuucaugcaacccgugaacgugucagcggaccuggcagcuauugucggugccgggccgaugccccgcaccgaaaucaucaagaagaugugggacuacaucaaggagaacagccugcaggauccaaccaacaagcggaauaucaacccggacgauaagcuggccaaaguguucggcaccgagaagccgauugacauguuucagaugaccaagauggugucccagcacaucauuaagcaccaccaccaucaucac

SEQ ID NO: 422 - RNA, 2019 nt, Artificial Sequence
  Synthetic Polynucleotide
auggaaaccccugcccaacugcuuuucuugcugcugcucuggcucccugacaccaccggaauggaaucuggacccgaguccgugucaagcaaccaguccuccaugaaccccaucauuaauggacagaucgcauccaauuccgaaaccaaggaaagcaccaaggcaucggaggccuccccauccgccucaagcuccgugucguccuggucguuucugucgagcgcgaagaaugcccugaucucacugcgggacgcgauucugaacaagaacagcuccccaaccgacucccugagccaacucgaggccucaacuuccacuucgacugugacuagggucgcugccaaggauuaugacgaggccaagagcaacuucgacaccgccaagagcggacuggaaaacgccaaaacccuggccgaauacgaaacuaagauggccgaucucauggcggcccugcaagacauggaacggcuggcgaacuccgauccguccaacaaccacacugaggaagugaacaacaucaagaaggcucucgaggcccagaaggauaccaucgacaaguugaacaagcuugugacgcugcagaaccaaaacaagucccugacggaagugcucaaaaccaccgacucggccgaccagauuccggccaucaacagccagcuggagauuaacaagaacucggccgaucagauuaucaaggaccuggagcgccagaacauuuccuacgaggccgucuugacuaacgccggcgaagugaucaaggcgucauccgaagccggcauuaagcugggacaggcgcugcaauccaucgucgacgccggcgaccagucccaggcggcggugcugcaggcccagcagaacaacucccccgauaacaucgcugcaaccaaggaacugauugacgcggccgaaaccaaagucaacgaacugaagcaggagcacacuggucugaccgacucgccgcucgugaagaaggccgaagaacagaucagccaggcucagaaggauauccaggaaaucaagccuucggggagcgacaucccgaucgugggaccguccgguuccgccgcuuccgccggguccgcagccggggcccuuaagucgucgaacaauagcggcagaauaucccugcugcucgacgauguggauaacgagauggccgccauugcgcugcaaggauuccgguccaugaucgagcaguucaacgugaacaaccccgccaccgccaaggagcugcaggcuauggaggcccaacucacugccauguccgaccagcucgugggagcggacggagaacugccagccgagauccaggccaucaaggacgcucuggcccaggcacugaagcagccguccgcggauggccuggccaccgccaugggccaggucgcguucgccgccgcuaaagucggcggagguucggccggcacugccgggaccgugcagaugaaugucaagcagcuguacaagacugcguucucgucgaccagcuccagcuccuacgccgcggcccuguccgacgguuacagcgcguacaagacccugaacucccuuuacuccgaaucgagauccgggguccaguccgcaauuucacaaaccgccaauccugcccugucgcgcucagugucacgcagcggcaucgagucacagggcagaagcgccgacgcuagccaaagggccgcagaaaccauugugcgggacucccagacacuuggagaugucuacagccgccuccaagugcuggacucccucauguccaccaucgugucaaacccucaggcuaaccaggaggaaaucaugcagaagcugaccgcaagcauuuccaaggcuccgcaguuuggauaccccgcugugcaaaacuccgcggacagcuugcagaaauucgcagcccaguuggagagggaguucguggacggggagcggucccucgcggagucccaggagaacgcauuccggaagcagcccgccuucauucaacaagugcuugugaacaucgccucccuguucuccgguuaccugucu

SEQ ID NO: 423 - RNA, 2037 nt, Artificial Sequence
  Synthetic Polynucleotide
auggaaaccccugcccaacugcuuuucuugcugcugcucuggcucccugacaccaccggaauggaaucuggacccgaguccgugucaagcaaccaguccuccaugaaccccaucauuaauggacagaucgcauccaauuccgaaaccaaggaaagcaccaaggcaucggaggccuccccauccgccucaagcuccgugucguccuggucguuucugucgagcgcgaagaaugcccugaucucacugcgggacgcgauucugaacaagaacagcuccccaaccgacucccugagccaacucgaggccucaacuuccacuucgacugugacuagggucgcugccaaggauuaugacgaggccaagagcaacuucgacaccgccaagagcggacuggaaaacgccaaaacccuggccgaauacgaaacuaagauggccgaucucauggcggcccugcaagacauggaacggcuggcgaacuccgauccguccaacaaccacacugaggaagugaacaacaucaagaaggcucucgaggcccagaaggauaccaucgacaaguugaacaagcuugugacgcugcagaaccaaaacaagucccugacggaagugcucaaaaccaccgacucggccgaccagauuccggccaucaacagccagcuggagauuaacaagaacucggccgaucagauuaucaaggaccuggagcgccagaacauuuccuacgaggccgucuugacuaacgccggcgaagugaucaaggcgucauccgaagccggcauuaagcugggacaggcgcugcaauccaucgucgacgccggcgaccagucccaggcggcggugcugcaggcccagcagaacaacucccccgauaacaucgcugcaaccaaggaacugauugacgcggccgaaaccaaagucaacgaacugaagcaggagcacacuggucugaccgacucgccgcucgugaagaaggccgaagaacagaucagccaggcucagaaggauauccaggaaaucaagccuucggggagcgacaucccgaucgugggaccguccgguuccgccgcuuccgccggguccgcagccggggcccuuaagucgucgaacaauagcggcagaauaucccugcugcucgacgauguggauaacgagauggccgccauugcgcugcaaggauuccgguccaugaucgagcaguucaacgugaacaaccccgccaccgccaaggagcugcaggcuauggaggcccaacucacugccauguccgaccagcucgugggagcggacggagaacugccagccgagauccaggccaucaaggacgcucuggcccaggcacugaagcagccguccgcggauggccuggccaccgccaugggccaggucgcguucgccgccgcuaaagucggcggagguucggccggcacugccgggaccgugcagaugaaugucaagcagcuguacaagacugcguucucgucgaccagcuccagcuccuacgccgcggcccuguccgacgguuacagcgcguacaagacccugaacucccuuuacuccgaaucgagauccgggguccaguccgcaauuucacaaaccgccaauccugcccugucgcgcucagugucacgcagcggcaucgagucacagggcagaagcgccgacgcuagccaaagggccgcagaaaccauugugcgggacucccagacacuuggagaugucuacagccgccuccaagugcuggacucccucauguccaccaucgugucaaacccucaggcuaaccaggaggaaaucaugcagaagcugaccgcaagcauuuccaaggcuccgcaguuuggauaccccgcugugcaaaacuccgcggacagcuugcagaaauucgcagcccaguuggagagggaguucguggacggggagcggucccucgcggagucccaggagaacgcauuccggaagcagcccgccuucauucaacaagugcuugugaacaucgccucccuguucuccgguuaccugucucaucaccaccaccaucac

SEQ ID NO: 424 - RNA, 1803 nt, Artificial Sequence
  Synthetic Polynucleotide
auggaaaccccugcccagcugcuguuccugcugcugcuguggcugccugauaccacaggcgugcggggagagucccucgugugcaagaaugcccugcaggaccugagcuuccuggaacaucugcugcaagugaaguacgcccccaagaccuggaaagagcaguaccugggcugggaccuggugcaguccucugugucugcccagcagaagcugcggacccaggaaaaccccucuaccagcuucugucagcaagugcuggccgacuucaucggcggccugaacgauuuccaugccggcgugaccuuuuucgccaucgagagcgccuaccugcccuacaccgugcagaaguccagcgacggccgguucuacuucguggacaucaugaccuucagcagcgagaucagagugggcgacgagcugcuggaaguggauggcgcuccugugcaggaugugcuggccacacuguacggcagcaaccacaagggcacagccgccgaagaaucugccgcccugagaacccuguucagccggauggccucucugggccacaaggugccaagcggcagaaccacccugaagaucagacggcccuuuggcaccacccgggaagugcgcgugaaguggcgcuaugugccugagggcgugggcgaccuggccacaaucgccccuucuaucagagccccccagcugcagaaauccaugcggucauucuucccaaagaaggacgacgccuuccaccgguccagcagccuguucuacagcccuauggugccccacuucugggccgagcugagaaaccacuacgccaccuccggccugaaguccggcuacaacaucggcagcaccgacggcuuucugcccgugaucggacccgugaucugggagagcgagggccuguucagagccuacaucagcagcgugaccgacggcgacggcaagagccacaaagugggcuuucugagaauccccaccuacagcuggcaggacauggaagauuucgaccccagcggcccaccccccugggaggaauuugccaagaucauccagguguucagcagcaacaccgaggcccugaucaucgaccagaccaacaacccuggcggcagcgugcuguaccuguacgcccugcugagcaugcugaccgacagaccccuggaacugcccaagcaccggaugauccugacccaggacgaggugguggacgcccuggauuggcugacccugcuggaaaacguggacaccaacguggaaagccggcuggcccugggcgacaacauggaaggcuacacaguggaucugcagguggccgaguaccugaaaagcuucggcagacaggugcugaacugcugguccaagggcgacaucgagcugagcacccccaucccccuguucggcuucgagaagauccacccccaccccagagugcaguacagcaagcccaucugcgugcugaucaacgagcaggacuucuccugcgccgacuucuucccaguggugcugaaggacaacgacagagcccugaucgugggcaccagaacagcuggcgcuggcggcuucguguucaacgugcaguuccccaaccggaccggcaucaagaccuguagccugacaggcucucuggccgugcgggaacacggcgccuucaucgagaacaucggcguggaaccccacaucgaccugccuuucaccgccaacgacauccgguacaagggcuacucugaguaccuggacaaagugaagaaacucgugugccagcugauuaacaacgacggcaccaucauccuggccgaggacggcagcuuc

SEQ ID NO: 425 - RNA, 1821 nt, Artificial Sequence
  Synthetic Polynucleotide
auggaaaccccugcccagcugcuguuccugcugcugcuguggcugccugauaccacaggcgugcggggagagucccucgugugcaagaaugcccugcaggaccugagcuuccuggaacaucugcugcaagugaaguacgcccccaagaccuggaaagagcaguaccugggcugggaccuggugcaguccucugugucugcccagcagaagcugcggacccaggaaaaccccucuaccagcuucugucagcaagugcuggccgacuucaucggcggccugaacgauuuccaugccggcgugaccuuuuucgccaucgagagcgccuaccugcccuacaccgugcagaaguccagcgacggccgguucuacuucguggacaucaugaccuucagcagcgagaucagagugggcgacgagcugcuggaaguggauggcgcuccugugcaggaugugcuggccacacuguacggcagcaaccacaagggcacagccgccgaagaaucugccgcccugagaacccuguucagccggauggccucucugggccacaaggugccaagcggcagaaccacccugaagaucagacggcccuuuggcaccacccgggaagugcgcgugaaguggcgcuaugugccugagggcgugggcgaccuggccacaaucgccccuucuaucagagccccccagcugcagaaauccaugcggucauucuucccaaagaaggacgacgccuuccaccgguccagcagccuguucuacagcccuauggugccccacuucugggccgagcugagaaaccacuacgccaccuccggccugaaguccggcuacaacaucggcagcaccgacggcuuucugcccgugaucggacccgugaucugggagagcgagggccuguucagagccuacaucagcagcgugaccgacggcgacggcaagagccacaaagugggcuuucugagaauccccaccuacagcuggcaggacauggaagauuucgaccccagcggcccaccccccugggaggaauuugccaagaucauccagguguucagcagcaacaccgaggcccugaucaucgaccagaccaacaacccuggcggcagcgugcuguaccuguacgcccugcugagcaugcugaccgacagaccccuggaacugcccaagcaccggaugauccugacccaggacgaggugguggacgcccuggauuggcugacccugcuggaaaacguggacaccaacguggaaagccggcuggcccugggcgacaacauggaaggcuacacaguggaucugcagguggccgaguaccugaaaagcuucggcagacaggugcugaacugcugguccaagggcgacaucgagcugagcacccccaucccccuguucggcuucgagaagauccacccccaccccagagugcaguacagcaagcccaucugcgugcugaucaacgagcaggacuucuccugcgccgacuucuucccaguggugcugaaggacaacgacagagcccugaucgugggcaccagaacagcuggcgcuggcggcuucguguucaacgugcaguuccccaaccggaccggcaucaagaccuguagccugacaggcucucuggccgugcgggaacacggcgccuucaucgagaacaucggcguggaaccccacaucgaccugccuuucaccgccaacgacauccgguacaagggcuacucugaguaccuggacaaagugaagaaacucgugugccagcugauuaacaacgacggcaccaucauccuggccgaggacggcagcuuccaccaccaccaucaccac

SEQ ID NO: 426 - RNA, 1833 nt, Artificial Sequence
  Synthetic Polynucleotide
auggaaaccccugcccagcugcuguuccugcugcugcuguggcugccugacaccaccggcaugagcaucagaggcgugggcggcaacggcaacagcagaaucccuagccacaacggcgacggcagcaacaggcggagccagaacaccaagggcaacaacaagguggaagauagagugugcagccuguacagcagccgguccaacgagaaccgcgagagcccuuaugccgugguggacguguccagcaugaucgagagcacccccaccagcggcgagacaaccagagcuaguagaggcgugcugagccgguuccagaggggccucgugcggauugcugacaaagugcggagagccgugcagugcgcuuggagcagcguguccacaagcagaagcagcgccacaagagccgccgagagcggcagcucuagcagaacagcuagaggcgccagcagcggcuacagagaguacagcccuucugccgcucggggccugcggcugauguucaccgacuuuuggcggacccgggugcugagacagaccucuccuauggccggcguguucggcaaccuggacgugaacgaggccagacugauggccgccuacaccagcgagugugccgaucaccuggaagccaaagagcuggccggaccugacggcguggcagccgcuagagaaaucgccaagagaugggagaagagagugcgggaccugcaggacaagggcgcugccagaaagcugcugaacgacccccugggcagacggacccccaacuaccagagcaagaaccccggcgaguacaccgugggcaacuccauguucuacgacggcccccagguggccaaccugcagaauguggauaccggcuucuggcuggacaugagcaaccugagcgacguggugcuguccagagagauccagaccggccugagagccagagccacccuggaagaguccaugcccaugcuggaaaaucuggaagagagauuccggcggcugcaggaaaccugcgacgccgccagaaccgagaucgaggaaagcggcuggacccgggaaagcgccuccagaauggaaggcgacgaagcccagggccccagcagagugcagcaggccuuucagagcuucgugaaugagugcaacagcaucgaguucagcuucggcuccuucggcgagcacgugcgggugcugugugccagagugucaagaggacuggccgcugccggcgaggccaucagaagaugcuucagcugcugcaagggcagcacccacagauacgcccccagagaugaccugucuccugagggcgccucucuggccgaaacccuggccagauucgccgacgacaugggcaucgaaagaggcgccgacggcaccuacgacaucccccugguggacgauuggagaaggggcgugccauccaucgagggcgagggcagcgauagcaucuacgagaucaugaugcccaucuacgaagugaugaacauggaccuggaaacccggcggagcuucgccgugcagcagggccauuaccaggaccccagagccagcgacuacgaccugccuagagccuccgauuacgaucugcccagaagccccuaccccaccccuccacugccucccagauaccagcugcagaacauggauguggaagccggcuuucgcgaggccguguacgccucuuuuguggccggcauguacaacuacgucgugacccagccccaggaacggauccccaauagccagcagguggaaggcauccugcgggacaugcugaccaacggcagccagaccuuccgggaccugaugaagcgguggaacagagagguggaccgcgag

SEQ ID NO: 427 - RNA, 1851 nt, Artificial Sequence; identical to SEQ ID NO: 408
  Synthetic Polynucleotide

SEQ ID NO: 428 - RNA, 1323 nt, Artificial Sequence
  Synthetic Polynucleotide
auggaaaccccugcccagcugcuguuccugcugcugcuguggcugccugacaccaccggcaugacagcaucuggcggagcuggcggccugggcucuacacagacaguggauguggccagggcccaggcugcugccgcuacacaggaugcccaggaagugaucggcagccaggaagccagcgaggccucuaugcugaagggcugcgaggaccugaucaacccugccgccgcuacccgcaucaagaagaaagaggaaaaguucgagucccuggaagccagacggaagcccaccgccgacaaggccgagaagaaguccgagagcaccgaggaaaagggcgacaccccccuggaagaucgguucaccgaggaucugagcgagguguccggcgaggacuuccggggccugaagaacagcuucgacgacgacagcagccccgaggaaauccuggacgcccugaccagcaaguucagcgaccccaccaucaaggaccuggcccuggacuaccugauccagaccgcccccagcgaccggaagcugaagucugcccugauucaggccaagcaccagcugaugagccagaacccccaggccaucgugggcggcagaaaugugcugcuggccuccgagacauucgccagcagagccaacaccagccccagcucccugcggagccuguaucugcaagugaccagcucccccagcaacugcgacaaccugagacagaugcuggcuagcuaccugcccuccgagaaaaccgccgugauggaauuccucgugaacggcaugguggccgaccugaaaagcgagggcccuagcaucccucccgccaagcugcagguguacaugaccgagcugagcaaccugcaggcccugcacagcguggacagcuuuuucgaccggaacaucggcaaccuggaaaacagccugaagcacgagggccacgcccccaucccuucucugacaaccggcaaucugaccaagaccuuccugcagcugguggaagauaaguuccccagcagcuccaaggcccagaaggcccugaacgagcucgugggcccugauaccggaccucagaccgaggugcugaaccuguucuuucgggcccugaauggcugcuccccccggaucuuuucuggcgcugagaagaagcagcagcuggccagcgugaucaccaacacccuggaugccaucaacgccgacaacgaggacuaccccaagcccggcgacuuccccagaagcagcuuuagcagcacccccccucaugccccugugccccagucugagaucccuaccagcccaaccagcacccagccuccaagcccu

SEQ ID NO: 429 - RNA, 1341 nt, Artificial Sequence
  Synthetic Polynucleotide
auggaaaccccugcccagcugcuguuccugcugcugcuguggcugccugacaccaccggcaugacagcaucuggcggagcuggcggccugggcucuacacagacaguggauguggccagggcccaggcugcugccgcuacacaggaugcccaggaagugaucggcagccaggaagccagcgaggccucuaugcugaagggcugcgaggaccugaucaacccugccgccgcuacccgcaucaagaagaaagaggaaaaguucgagucccuggaagccagacggaagcccaccgccgacaaggccgagaagaaguccgagagcaccgaggaaaagggcgacaccccccuggaagaucgguucaccgaggaucugagcgagguguccggcgaggacuuccggggccugaagaacagcuucgacgacgacagcagccccgaggaaauccuggacgcccugaccagcaaguucagcgaccccaccaucaaggaccuggcccuggacuaccugauccagaccgcccccagcgaccggaagcugaagucugcccugauucaggccaagcaccagcugaugagccagaacccccaggccaucgugggcggcagaaaugugcugcuggccuccgagacauucgccagcagagccaacaccagccccagcucccugcggagccuguaucugcaagugaccagcucccccagcaacugcgacaaccugagacagaugcuggcuagcuaccugcccuccgagaaaaccgccgugauggaauuccucgugaacggcaugguggccgaccugaaaagcgagggcccuagcaucccucccgccaagcugcagguguacaugaccgagcugagcaaccugcaggcccugcacagcguggacagcuuuuucgaccggaacaucggcaaccuggaaaacagccugaagcacgagggccacgcccccaucccuucucugacaaccggcaaucugaccaagaccuuccugcagcugguggaagauaaguuccccagcagcuccaaggcccagaaggcccugaacgagcucgugggcccugauaccggaccucagaccgaggugcugaaccuguucuuucgggcccugaauggcugcuccccccggaucuuuucuggcgcugagaagaagcagcagcuggccagcgugaucaccaacacccuggaugccaucaacgccgacaacgaggacuaccccaagcccggcgacuuccccagaagcagcuuuagcagcacccccccucaugccccugugccccagucugagaucccuaccagcccaaccagcacccagccuccaagcccucaccaccaccaucaccac

SEQ ID NO: 430 - RNA, 1173 nt, Artificial Sequence
  Synthetic Polynucleotide
augaaaaaacucuuaaaaucggcguuuuuauccgccgcauuuuuugcuggucacgccuccuuacacgcuuugccuguagggaacccagcagagccaaguuuauuaauugauggaacgauaugggaagguaugucaggagauccaugugauccuugcgcuacuuggugcgacgcgauuagcuuacgcguaggauuuuacggagauuauguuuucgacagaguccucaagacagaugugccacagaaguuuucaauggggccuauaccuacuucaaguacuucuccugaagacucagcuauacuaacagagagaaauaacgcagcguauggaaaacauaugcacgaugcggaguuguucacaaaugcagguuacauugcgcuaaauauuugggaccguuucgacaucuuuuguaccuuaggagcuacuaguggguauuuuaaagggaauucuucaucuuucaacuugaucggauugauugguauuucaggagcagaccuuaacagcaagcucccaaacgcaaauauuucuaacggcguaguagagcuauauacagacacaaccuucucuuggagcguuggagcucgcggagcuuugugggagugugguugcgcuacuuuaggagcagaauuccaauacgcacaaucgaaaccucgcguucaagaauugaaugucuugucuaacguagcacaauuuacuguacacaaaccucggggauauguaggccagccucuaccucuuccacugacugcaggaacagcaacugauucuaaugauaaauugaaaaaugccacgaucaacuaccaugaauggcaagucggugcagcauugucauauagacugaauaugcucguuccuuacaucgguguucagugguccagagcuacuuuugaugcagauacuauccaaauugcggaaccaaaauuagcuucgccaauuuucaacuugacaacauggaauccaacauuauuaggacaagcaacuucaguagauagcggaaacaaguuugcugacucccuacaaauuguuucucuucaaauuaacaaguugaaguccagaaaagcuugugguguuuccaugggagcaacuuuacuugaugccgauaaaugggcaaucaauggggaacuucguuuaauuaacgaaagagcugcucaccuuucugcucaaugcagauuc

SEQ ID NO: 431 - RNA, 1500 nt, Human papillomavirus
auguggcggccuagcgacagcacaguauaugugccuccuccuaacccuguauccaaaguuguugccacggaugcuuauguuacucgcaccaacauauuuuaucaugccagcaguuccagacuucuugcagugggacauccuuauuuuuccauaaaacgggcuaacaaaacuguugugccaaaggugucaggauaucaauacaggguauuuaaggugguguuaccagauccuaacaaauuugcauugccugacucgucucuuuucgaucccacaacacaacguuuaguaugggcaugcacaggccuagaggugggcaggggacagccauuagguguggguguaaguggacauccuuuccuaaauaaauaugaugauguugaaaauucagggaguggugguaacccuggacaggauaacaggguuaauguagguauggauuauaaacaaacacaauuaugcaugguuggaugugcccccccuuugggcgagcauugggguaaagguaaacaguguacuaauacaccuguacaggcuggugacugcccgcccuuagaacuuauuaccaguguuauacaggauggcgauaugguugacacaggcuuuggugcuaugaauuuugcugauuugcagaccaauaaaucagauguuccuauugacauauguggcacuacauguaaauauccagauuauuuacaaauggcugcagacccauauggugauagauuauuuuuuuuucuacggaaggaacaaauguuugccagacauuuuuuuaacagggcuggcgaggugggggaaccugugccugauacacuuauaauuaaggguaguggaaaucgcacgucuguagggaguaguauauauguuaacaccccgagcggcucuuugguguccucugaggcacaauuguuuaauaagccauauuggcuacaaaaagcccagggacauaacaaugguauuuguugggguaaucaacuguuuguuacugugguagauaccacacgcaguaccaacaugacauuaugugcauccguaacuacaucuuccacauacaccaauucugauuauaaagaguacaugcgucauguggaagaguaugauuuacaauuuauuuuucaauuauguagcauuacauugucugcugaaguaauggccuauauucacacaaugaaucccucuguuuuggaagacuggaacuuuggguuaucgccucccccaaaugguacauuagaagauaccuauagguaugugcagucacaggccauuaccugucaaaagcccacuccugaaaaggaaaagccagaucccuauaagaaccuuaguuuuugggagguuaauuuaaaagaaaaguuuucuagugaauuggaucaguauccuuugggacgcaaguuuuuguuacaaaguggauauaggggacgguccucuauucguacagguguuaagcgcccugcuguuuccaaagccucugcugccccuaaacguaagcgcgccaaaacuaaaagg

SEQ ID NO: 432 - RNA, 1503 nt, Human papillomavirus
auguggcggccuagcgacagcacaguauaugugccuccucccaacccuguauccaagguuguugccacggaugcguauguuaaacgcaccaacauauuuuaucaugccagcaguuccagacuccuugcugugggacauccauauuacucuaucaaaaaaguuaacaaaacaguuguaccaaaggugucuggauaucaauauagaguguuuaagguaguguugccagauccuaacaaguuugcauuaccugauucaucccuguuugaccccacuacacagcguuuaguaugggcgugcacaggguuggagguaggcaggggucaaccuuuaggcguugguguuagugggcauccauugcuaaacaaauaugaugauguagaaaauagugguggguauggugguaauccuggucaggauaauaggguuaauguagguauggauuauaaacaaacccagcuauguauggugggcugugcuccaccguuaggugaacauugggguaaggguacacaauguucaaauaccucuguacaaaauggugacugccccccguuggaacuuauuaccaguguuauacaggauggggacaugguugauacaggcuuuggugcuaugaauuuugcagacuuacaaaccaauaaaucggauguuccccuugauauuuguggaacugucugcaaauauccugauuauuugcaaauggcugcagacccuuauggugauagguuguuuuuuuauuugcgaaaggaacaaauguuugcuagacacuuuuuuaauagggccgguacugugggggaaccugugccugaugaccuguugguaaaaggggguaauaacagaucaucuguagcuaguaguauuuauguacauacaccuaguggcucauuggugucuucagaggcucaauuauuuaauaaaccauauuggcuucaaaaggcucagggacauaacaaugguauuugcuggggaaaccacuuguuuguuacugugguagauaccacacgcaguacaaauaugacacuaugugcaucugugucuaaaucugcuacauacacuaauucagauuauaaggaauacaugcgccauguggaggaguuugauuuacaguuuauuuuucaauuguguagcauuacauuaucugcagaagucauggccuauauacacacaaugaauccuucuguuuuggaggacuggaacuuugguuuaucgccuccaccaaaugguacacuggaggauacuuauagauauguacagucacaggccauuaccugucagaaacccacaccugaaaaagaaaaacaggaucccuauaaggauaugaguuuuugggagguuaacuuaaaagaaaaguuuucaagugaauuagaucaguuuccccuuggacguaaguuuuuauugcaaaguggauaucgaggacggacgucugcucguacagguauaaagcgcccagcugugucuaagcccucuacagcccccaaacgaaaacguaccaaaaccaaaaag

SEQ ID NO: 433 - RNA, 1515 nt, Human papillomavirus
augucucuuuggcugccuagugaggccacugucuacuugccuccugucccaguaucuaagguuguaagcacggaugaauauguugcacgcacaaacauauauuaucaugcaggaacauccagacuacuugcaguuggacaucccuauuuuccuauuaaaaaaccuaacaauaacaaaauauuaguuccuaaaguaucaggauuacaauacaggguauuuagaauacauuuaccugaccccaauaaguuugguuuuccugacaccucauuuuauaauccagauacacagcggcugguuugggccuguguagguguugagguaggucguggucagccauuaggugugggcauuaguggccauccuuuauuaaauaaauuggaugacacagaaaaugcuagugcuuaugcagcaaaugcagguguggauaauagagaauguauaucuauggauuacaaacaaacacaauuguguuuaauugguugcaaaccaccuauaggggaacacuggggcaaaggauccccauguaccaauguugcaguaaauccaggugauuguccaccauuagaguuaauaaacacaguuauucaggauggugauaugguugauacuggcuuuggugcuauggacuuuacuacauuacaggcuaacaaaagugaaguuccacuggauauuuguacaucuauuugcaaauauccagauuauauuaaaauggugucagaaccauauggcgacagcuuauuuuuuuauuuacgaagggaacaaauguuuguuagacauuuauuuaauagggcugguacuguuggugaaaauguaccagacgauuuauacauuaaaggcucugggucuacugcaaauuuagccaguucaaauuauuuuccuacaccuagugguucuaugguuaccucugaugcccaaauauucaauaaaccuuauugguuacaacgagcacagggccacaauaauggcauuuguugggguaaccaacuauuuguuacuguuguugauacuacacgcaguacaaauaugucauuaugugcugccauaucuacuucagaaacuacauauaaaaauacuaacuuuaaggaguaccuacgacauggggaggaauaugauuuacaguuuauuuuucaacugugcaaaauaaccuuaacugcagacguuaugacauacauacauucuaugaauuccacuauuuuggaggacuggaauuuuggucuacaaccucccccaggaggcacacuagaagauacuuauagguuuguaacaucccaggcaauugcuugucaaaaacauacaccuccagcaccuaaagaagauccccuuaaaaaauacacuuuuugggaaguaaauuuaaaggaaaaguuuucugcagaccuagaucaguuuccuuuaggacgcaaauuuuuacuacaagcaggauugaaggccaaaccaaaauuuacauuaggaaaacgaaaagcuacacccaccaccucaucuaccucuacaacugcuaaacgcaaaaaacguaagcug

SEQ ID NO: 434 - RNA, 1521 nt, Human papillomavirus
auggcuuuguggcggccuagugacaauaccguauaucuuccaccuccuucuguggcaagaguuguaaauaccgaugauuaugugacucgcacaagcauauuuuaucaugcuggcagcuccagauuauuaacuguugguaauccauauuuuaggguuccugcaggugguggcaauaagcaggauauuccuaagguuucugcauaccaauauagaguauuuagggugcaguuaccugacccaaauaaauuugguuuaccugauacuaguauuuauaauccugaaacacaacguuuagugugggccugugcuggaguggaaauuggccguggucagccuuuagguguuggccuuagugggcauccauuuuauaauaaauuagaugacacugaaaguucccaugccgccacgucuaauguuucugaggacguuagggacaaugugucuguagauuauaagcagacacaguuauguauuuugggcugugccccugcuauuggggaacacugggcuaaaggcacugcuuguaaaucgcguccuuuaucacagggcgauugccccccuuuagaacuuaaaaacacaguuuuggaagauggugauaugguagauacuggauauggugccauggacuuuaguacauugcaagauacuaaaugugagguaccauuggauauuugucagucuauuuguaaauauccugauuauuuacaaaugucugcagauccuuauggggauuccauguuuuuuugcuuacggcgugagcagcuuuuugcuaggcauuuuuggaauagagcagguacuaugggugacacugugccucaauccuuauauauuaaaggcacagguaugcgugcuucaccuggcagcuguguguauucucccucuccaaguggcucuauuguuaccucugacucccaguuguuuaauaaaccauauugguuacauaaggcacagggucauaacaaugguguuugcuggcauaaucaauuauuuguuacugugguagauaccacucgcaguaccaauuuaacaauaugugcuucuacacagucuccuguaccugggcaauaugaugcuaccaaauuuaagcaguauagcagacauguugaggaauaugauuugcaguuuauuuuucaguuguguacuauuacuuuaacugcagauguuauguccuauauucauaguaugaauagcaguauuuuagaggauuggaacuuugguguuccccccccgccaacuacuaguuugguggauacauaucguuuuguacaaucuguugcuauuaccugucaaaaggaugcugcaccggcugaaaauaaggaucccuaugauaaguuaaaguuuuggaauguggauuuaaaggaaaaguuuucuuuagacuuagaucaauauccccuuggacguaaauuuuugguucaggcuggauugcgucgcaagcccaccauaggcccucgcaaacguucugcuccaucugccacuacgucuucuaaaccugccaagcgugugcguguacgugccaggaag

SEQ ID NO: 435 - RNA, 1512 nt, Human papillomavirus
augucucuguggcggccuagcgaggcuacugucuacuuaccaccugucccagugucuaaaguuguaagcacggaugaauauguaacacgaaccaacauauauuaucacgcaggcagugcuaggcugcuuacaguaggccauccauauuauuccauaccuaaaucugacaauccuaaaaaaauaguuguaccaaaggugucaggauuacaauauaggguauuuaggguucguuuaccagauccaaacaaauuuggauuuccugauacaucuuuuuauaauccugaaacucaacgcuuaguuugggccuguguugguuuagagguaggucgcgggcagccauuagguguagguauuaguggucauccauuauuaaauaaauuugaugacacugaaaacucuaauagauaugccggugguccuggcacugauaauagggaauguauaucaauggauuauaaacaaacacaacuguguuuacuugguugcaaaccaccuauuggagagcauugggguaaagguaguccuuguaguaacaaugcuauuaccccuggugauuguccuccauuagaauuaaaaaauucaguuauacaagauggggauaugguugauacaggcuuuggagcuauggauuuuacugcuuuacaagacacuaaaaguaauguuccuuuggacauuuguaauucuauuuguaaauauccagauuaucuuaaaaugguugcugagccauauggcgauacauuauuuuuuuauuuacguagggaacaaauguuuguaaggcauuuuuuuaauagaucaggcacgguuggugaaucggucccuacugacuuauauauuaaaggcuccgguucaacagcuacuuuagcuaacaguacauacuuuccuacaccuagcggcuccaugguuacuucagaugcacaaauuuuuaauaaaccauauuggaugcaacgugcucagggacacaauaaugguauuuguuggggcaaucaguuauuuguuacugugguagauaccacacguaguaccaauaugucuguuugugcugcaauugcaaacagugauacuacauuuaaaaguaguaauuuuaaagaguauuuaagacauggugaggaauuugauuuacaauuuauauuucaguuaugcaaaauaacauuaucugcagacauaaugacauauauucacaguaugaauccugcuauuuuggaagauuggaauuuuggauugaccacaccucccucagguucuuuggaggauaccuauagguuugucaccucacaggccauuacaugucaaaaaacugccccccaaaagcccaaggaagauccauuuaaagauuauguauuuugggagguuaauuuaaaagaaaaguuuucugcagauuuagaucaguuuccacugggucgcaaauuuuuauuacaggcaggauauagggcacguccuaaauuuaaagcagguaaacguagugcacccucagcaucuaccacuacaccagcaaaacguaaaaaaacuaaaaag

SEQ ID NO: 436 - RNA, 1497 nt, Human papillomavirus
auguccguguggcggccuagugaggccacaguguaccugccuccuguaccuguaucuaaaguugucagcacugaugaauaugugucucgcacaagcauuuauuauuaugcugguaguuccagacuucuugcuguuggccauccauauuuuucuauuaaaaauccuacuaacgcuaaaaaauuauugguacccaaaguaucaggcuugcaauauaggguuuuuaggguccguuuaccagauccuaauaaauuuggauuuccugacaccuccuuuuauaacccugauacacaacgauuaguaugggcauguguaggccuugaaauagguagagggcagccauuaggcguuggcauaaguggucauccuuuauuaaacaaauuugaugacacugaaaccgguaacaaguauccuggacaaccgggugcugauaauagggaauguuuauccauggauuauaaacaaacacaguuauguuuacuuggauguaagccuccaacaggggaacauugggguaaagguguugcuuguacuaaugcagcaccugccaaugauuguccaccuuuagaacuuauaaauacuauuauugaggauggugauaugguggacacaggauuugguugcauggauuuuaaaacauugcaggcuaauaaaagugauguuccuauugauauuuguggcaguacaugcaaauauccagauuauuuaaaaaugacuagugagccuuauggugauaguuuauuuuucuuucuucgacgugaacaaauguuuguaagacacuuuuuuaauagggcugguacauuaggagaggcuguucccgaugaccuguacauuaaagguucaggaacuacugccucuauucaaagcagugcuuuuuuucccacuccuaguggaucaaugguuacuuccgaaucucaguuauuuaauaagccauauuggcuacaacgugcacaaggucauaauaaugguauuuguuggggcaaucagguauuuguuacugugguagauaccacucgcaguacuaauaugacuuuaugcacacaaguaacuagugacaguacauauaaaaaugaaaauuuuaaagaauauauaagacauguugaagaauaugaucuacaguuuguuuuucaacuaugcaaaguuaccuuaacugcagaaguuaugacauauauucaugcuaugaauccagauauuuuagaagauuggcaauuugguuuaacaccuccuccaucugcuaguuuacaggauaccuauagguuuguuaccucucaggcuauuacgugucaaaaaacaguaccuccaaaggaaaaggaagaccccuuagguaaauauacauuuugggaaguggauuuaaaggaaaaauuuucagcagauuuagaucaguuuccuuugggacgcaaguuuuuauuacaggcaggucuuaaagcaaaaccuaaacuuaaacgugcagcccccacauccacccgcacaucgucugcaaaacgcaaaaagguuaaaaaa

SEQ ID NO: 437 - RNA, 1506 nt, Human papillomavirus
augucucuguggcggucuaacgaagccacugucuaccugccuccagugucagugucuaagguuguuagcacugaugaauauguaacacgcacaaacaucuacuaucaugcaggcaguucuaggcuauuagcugugggucacccauacuaugcuauuaaaaaacaagauucuaauaaaauagcaguacccaagguaucugguuugcaauacagaguauuuagaguaaaauuaccagauccuaauaaguuuggauuuccagacacaucauuuuaugauccugccucccagcguuugguuugggccuguacaggaguugaaguaggucguggucagccauuggguguagguauuaguggucauccuuuacucaauaaauuggaugauacugaaaauucuaauaaauauguugguaacucugguacagauaacagggaaugcauuucuauggauuauaaacaaacacaauuguguuuaauagguuguaggccuccuauaggugaacauuggggaaaaggcacaccuuguaaugcuaaccagguaaaagcaggagaauguccuccuuuggaguuacuaaacacuguacuacaagacggggacaugguagacacaggauuuggugcaauggauuuuacuacauuacaagcuaauaaaagugauguuccccuagauauaugcaguuccauuugcaaauauccugauuaucuaaaaaugguuucugagccauauggagauauguuauuuuuuuaucuacguagggagcaaauguuugugagacauuuauuuaauagggcuggaacuguaggugaaacaguaccugcagaccuauauauuaaggguaccacuggcacauugccuaguacuaguuauuuuccuacuccuaguggcucuaugguaaccuccgaugcacaaauauuuaauaaaccauauugguugcaacgugcacaaggccauaauaaugguauuuguuggaguaaccaauuguuuguuacuguaguugauacaacccguaguacaaauaugucuguguguucugcugugucuucuagugacaguacauauaaaaacgacaauuuuaaggaauauuuaaggcauggugaagaauaugaccugcaguuuauuuuucaguuauguaaaauaacacuaacagcagauguuaugacauauauucauaguaugaacccguccauuuuagaggauuggaauuuuggccuuacaccaccgccuucugguaccuuagaggacacauaucgcuauguaacaucacaggcuguaacuugucaaaaacccagugcaccaaaaccuaaagaugauccauuaaaaaauuauacuuuuugggagguugauuuaaaggaaaaguuuucugcagacuuagaucaauuuccguugggccguaaauuuuuguuacaagcaggacuaaaggccaggccuaauuuuagauuaggcaagcgugcagcuccagcaucuacaucuaaaaaaucuucuacuaaacguagaaaaguaaaaagu

SEQ ID NO: 438 - RNA, 1515 nt, Human papillomavirus
auggcuauguggcggucuagugacagcaugguguauuugccuccaccuucuguggcgaagguugucaauacugaugauuauguuacacgcacaggcauauauuauuaugcuggcagcuccagauuauuaacaguaggacauccauauuuuaaaguggguaugaaugguggucgcaagcaggacauuccaaaggugucugcauaucaauauaggguauuucgcgugacauugcccgauccuaauaaauucaguauuccagaugcauccuuauauaauccagaaacacaacguuuaguaugggcuuguguagggguggaggugggcaggggccagccauuggguguugguauuaguggacacccauuauauaauagacaggaugauacugaaaacucaccauuuucaucaaccaccaauaaggacaguagggauaaugugucuguggauuauaaacagacacaguugugcauuauaggcuguguucccgccauuggggagcacugggguaagggaaaggcaugcaagcccaauaauguaucuacgggggacuguccuccuuuggaacuaguaaacaccccuauugaggauggugauaugauugauacuggcuauggagcuauggacuuuggugcauugcaggaaaccaaaagugaggugccuuuagauauuugucaauccauuuguaaauauccugauuauuugcaaaugucugcagauguguauggggacaguauguucuucuguuuacguagggaacaacuguuugcaagacauuuuuggaaucguggugguauggugggugacgccauuccugcccaauuguauauuaagggcacagauauacgugcaaaccccgguaguucuguauacugccccucucccagcgguuccaugguaaccucugauucccaguuauuuaauaagccuuauuggcuacauaaggcccagggccacaacaaugguauauguuggcauaaucaauuauuucuuacuguuguggacacuacccguaguaccaacuuuacauuaucuaccucuauagagucuuccauaccuucuacauaugauccuucuaaguuuaaggaauauaccaggcacguggaggaguaugauuuacaguuuauauuucaacuguguacugucacauuaacaacugauguuaugucuuauauucacacuaugaauuccucuauauuggacaauuggaauuuugcuguagcuccuccaccaucugccaguuugguagacacuuacagauaccuacagucugcagccauuacaugucaaaaggaugcuccagcaccugaaaagaaagauccauaugacggucuaaaguuuuggaauguugacuuaagggaaaaguuuaguuuggaacuugaucaauucccuuugggacguaaauuuuuguugcaggccaggguccgcaggcgcccuacuauagguccccgaaagcggccugcugcauccacuuccucguccucagcuacuaaacacaaacguaaacgugugucuaaa

SEQ ID NO: 439 - RNA, 1539 nt, Human papillomavirus
auggcuuuguggcggccuagugacaguacgguauaucuuccaccaccuucuguggccagaguugucagcacugaugauuaugugucucgcacaagcauauuuuaucaugcaggcaguucccgauuauuaacuguaggcaauccauauuuuaggguuguaccuaauggugcagguaauaaacaggcuguuccuaagguauccgcauaucaguauaggguguuuagaguagcuuuacccgauccuaauaaauuuggauuaccugauucuacuauauauaauccugaaacacaacguuugguuugggcauguguagguauggaaauuggucgugggcagccuuuagguauuggccuaaguggccauccauuuuauaauaaauuggaugauacagaaagugcucaugcagcuacagcuguuauuacgcaggauguuagggauaaugugucaguugauuauaagcaaacacagcuguguauuuuagguuguguaccugcuauuggugagcacugggccaagggcacacuuuguaaaccugcacaauugcaaccuggugacuguccuccuuuggaacuuaaaaacaccauuauugaggauggugauaugguggauacagguuauggggcaauggauuuuaguacauugcaggauacaaagugcgagguuccauuagacauuugucaauccaucuguaaauauccagauuauuugcaaaugucugcugaucccuauggggauucuauguuuuuuugccuacgccgugaacaacuguuugcaagacauuuuuggaauagggcagguguuaugggugacacaguaccuacggaccuauauauuaaaggcacuagcgcuaauaugcgugaaaccccuggcaguuguguguauuccccuucucccaguggcucuauuauuacuucugauucucaauuauuuaauaagccauauugguuacauaaggcccagggccauaacaaugguauuuguuggcauaaucaguuguuuguuacuguaguggacacuacccgcaguacuaauuuaacauuaugugccucuacacaaaauccugugccaaguacauaugacccuacuaaguuuaagcaguauaguagacauguggaggaauaugauuuacaguuuauuuuucaguugugcacuauuacucucacugcagagguuaugucauauauccauaguaugaauaguaguauauuagaaaauuggaauuuuggugucccuccaccaccuacuacaaguuugguggauacauaucguuuugugcaaucaguugcuguuaccugucaaaaggauacuacaccuccagaaaagcaggauccauaugauaaauuaaaguuuuggacuguugaccuaaaggaaaaauuuuccuccgauuuggaucaauauccccuuggucgaaaguuuuuaguucaggcuggguuacgucguaggccuaccauaggaccucguaagcguccugcugcuuccacgucuacugcaucuacugcaucuaggccugccaaacguguacguauacguaguaagaaa

SEQ ID NO: 440 - RNA, 1512 nt, Human papillomavirus
auggcauuguggcgcacuaaugacagcaagguguauuugccaccugcaccugugucucgaauugugaauacagaagaauauaucacacgcaccggcauauauuacuaugcaggcaguuccagacuaauaacauuaggacaucccuauuuuccaauaccuaaaaccucaacgcgugcugcuauuccuaaaguaucugcauuucaauacaggguauuuaggguacaguuaccagauccuaacaaguuuggacucccggauccaaauuuauauaauccagacacagauagguuggugugggguugugugggcguugaggugggcagaggacagccccuugguguuggccuuaguggucaucccuuauuuaauaaauaugaugacacagaaaauucacgcauagcaaauggcaaugcacaacaagauguuagagauaacacaucuguugacaacaaacagacucaguuauguauaauaggcugugcuccaccuauuggggaacacugggguauuggcacuacaugcaaaaacacaccuguaccuccaggagacugccccccccuggaacuuguauccucugucauucaggauggcgauaugauugauacaggguuuggagcuauggauuucgcugcccuacaggccaccaaaucagacgucccuuuggauauuucacagucuguuuguaaauauccugauuauuuaaaaaugucugcagacacauaugguaauuccauguuuuuucauuuacgcagggagcaaaucuuugcuaggcacuauuauaauaaacuuguagguguuggggaagacauuccuaacgauuauuauauuaaggguagugguaauggccgugacccuauagaaaguuauauauacucugcuacucccagugggucuaugauaacaucugauucucaaauuuuuaauaagccuuauuggcuccaccgugcgcagggucacaauaauggcauuugcuggaacaaucagcuuuuuauuaccuguguugauacuaccagaaguacaaauuuaacuauuagcacugccacugcugcgguuuccccaacauuuacuccaaguaacuuuaagcaauauauuaggcauggggaagaguaugaauugcaauuuauuuuucaauuauguaaaauuacucugacuacagagguaauggcuuauuuacacacaauggauccuaccauucuugaacaguggaauuuuggauuaacauuaccuccgucugcuaguuuggaggaugcauauagguuuguuagaaaugcagcuacuagcugucaaaaggacaccccuccacaggcuaagccagauccuuuggccaaauauaaauuuugggauguugauuuaaaggaacgauuuucuuuagauuuagaccaauuugcauugggucgcaaguuuuuguugcagguuggcguacaacgcaagcccagaccaggccuuaaacgcccggccucaucggcauccucuuccucuuccucuucagccaaacguaaacguguuaaaaag

SEQ ID NO: 441 - RNA, 1509 nt, Human papillomavirus
auguccguguggcggccuagugaggccacuguguaccugccuccuguaccugucucuaagguuguaagcacugaugaguaugugucucgcacaagcaucuauuauuaugcaggcaguucucgauuacuaacaguaggacaucccuauuuuucuauuaaaaacaccaguagugguaaugguaaaaaaguuuuaguucccaaggugucuggccugcaauacaggguauuuagaauuaaauugccggacccuaauaaauuugguuuuccagauacaucuuuuuauaacccagaaacccaaagguuggugugggccuguacaggcuuggaaauugguaggggacagccuuuagguguggguauuagugggcauccuuuauuaaacaaguuugaugauacugaaaccaguaacaaauaugcugguaaaccugguauagauaauagggaauguuuaucuauggauuauaagcagacucaguuaugcauuuuaggaugcaaaccuccuauaggugaacauugggguaagggaaccccuuguaauaauaauucaggaaauccuggggauuguccuccccuacagcucauuaacaguguaauacaggauggggacaugguagauacaggauuugguugcauggauuuuaauaccuugcaagcuaguaaaagugaugugcccauugauauauguagcaguguauguaaguauccagauuauuugcaaauggcuagcgagccauauggugacaguuuguucuuuuuucuuagacgugagcaaauguuuguuagacacuuuuuuaauagggccgguaccuuaggugacccugugccaggugauuuauauauacaagggucuaacucuggcaauacugccacuguacaaagcagugcuuuuuuuccuacuccuagugguucuaugguaaccucagaaucccaauuauuuaauaaaccguacugguuacaacgugcgcagggccacaauaauggcauauguuggggcaaucaguuguuugucacaguuguggauaccacucguagcacuaacaugacuuuaugugcugagguuaaaaaggaaagcacauauaaaaaugaaaauuuuaaggaauaccuucgucauggcgaggaauuugauuuacaguuuauuuuucaguugugcaaaauuacauuaacagcugauguuaugacauacauucauaagauggaugccacuauuuuagaggacuggcaauuuggccuuaccccaccaccgucugcaucuuuggaggacacauacagauuugucacuucuacugcuauaacuugucaaaaaaacacaccaccuaaaggaaaggaagauccuuuaaaggacuauauguuuugggagguggauuuaaaagaaaaguuuucugcagauuuagaucaguuuccuuuagguaggaaguuuuuguuacaggcagggcuacaggcuaggcccaaacuaaaacgcccugcaucaucggccccacguaccuccacaaagaagaaaaagguuaaaagg

SEQ ID NO: 442 - RNA, 1497 nt, Human papillomavirus
auggcgacguggcggccuagugaaaauaagguguaucuaccuccaacaccuguuucaaagguuguggcaacggauuccuauguaaaacgcacuaguauauuuuaucaugcaggcaguucacgauugcuugccguaggacaucccuauuacucugugacuaaggacaauaccaaaacaaacauucccaaaguuagugcauaucaauauaggguauuuaggguacgguugcccgacccuaauaaguuugggcuuccagauacuaauauuuauaauccggaccaggaacgguuagugugggcauguguagguuuggagguaggccgcggacagccuuuaggugcugggcuaaguggccauccauuguuuaauaggcuggaugauacugaaaguuccaauuuagcaaauaauaauguuauagaagauaguagggacaauauaucaguugauggcaagcaaacacaguuguguauuguuggauguacucccgcuaugggugaacauuggacuaaaggugcuguguguaaguccacacaaguuaccacaggggacugcccgccucuugcauuaauuaauacaccuauagaggauggggacaugauagacacaggauuuggcgcuauggacuuuaagguguugcaggaaucuaaggcugagguaccuuuagacauuguacaauccaccuguaaauauccugacuauuuaaaaaugucugcagaugccuauggugauucuaugugguuuuacuuacgcagggaacaauuauuugccagacauuauuuuaauagggcugguaaaguuggggaaacaauaccugcagaguuauauuuaaaggguagcaaugguagagaacccccuccgaguucuguauauguugcuacgccuagugggucuaugauuacgucugaggcacaguuauuuaauaaaccuuauugguugcaacgugcccaaggccauaauaauggcauuugcugggguaaucaauuauuuguuacuguaguagauacuacuagaaguacuaacaugacuauuaguacugcuacagaacagcucaguaaauaugaugcacgaaaaauuaaucaguaccuuagacauguggaggaauaugaauuacaauuuguuuuucaauuaugcaaaauuacuuugucugcagagguuauggcauauuuacauaauaugaaugcuaaccuacuggaggacuggaauauuggguuauccccgccaguggccaccagccuagaagauaaauauagauauguuagaagcacagcuauaacaugucaacgggaacagccaccaacagaaaaacaggacccauuagcuaaauauaaauuuugggauguuaacuuacaggacaguuuuucuacagaccuggaucaauuuccacuggguagaaaauuuuuaaugcaacugggcacuaggucaaagccugcuguagcuaccucuaaaaagcgaucugcuccuaccuccaccucuacaccagcaaaacguaaaaggcgg

SEQ ID NO: 443 - RNA, 1494 nt, Human papillomavirus
auguccguguggcggccuagugaggccacuguguaccugccuccugugccugugucuaagguuguaagcacugaugaauaugugucacgcacaagcauuuauuauuaugcuggcaguuccagacuuuuggcuguuggcaauccauauuuuuccaucaaaagucccaauaacaauaaaaaaguauuaguucccaagguaucaggcuuacaguauagggucuuuagggugcguuuaccugaucccaauaaauuugguuuuccugauacaucuuuuuauaacccugauacacaacguuuggucugggcauguguaggccuugaaauagguaggggacagccauuggguguuggcguaaguggucauccuuauuuaaauaaauuugaugacacugaaaccaguaacagauaucccgcacagccagggucugauaacagggaaugcuuaucuauggauuauaaacaaacacaauuauguuuaauuggcuguaaaccucccacuggugagcauugggguaaagguguugccuguaacaauaaugcagcugcuacugauuguccuccauuggaacuuuuuaauucuauuauugaggauggugacaugguagauacaggguuuggaugcauggacuuugguacauugcaggcuaauaaaagugaugugccuauugauauuuguaacaguacaugcaaauauccagauuauuuaaaaauggccagugaaccuuauggggauaguuuguucuuuuuucuuagacgugagcagauguuuguuagacacuuuuuuaauagggcuggaaaacuuggcgaggcugucccggaugaccuuuauauuaaaggguccgguaauacugcaguuauccaaaguagugcauuuuuuccaacuccuaguggcucuauaguuaccucagaaucacaauuauuuaauaagccuuauuggcuacagcgugcacaaggucauaacaauggcauuugcuggggcaaucaguuauuuguuaccgugguugauaccacucguagcacuaauaugacauuaugcacugaaguaacuaaggaagguacauauaaaaaugauaauuuuaaggaauauguacgucauguugaagaauaugaccuacaguuuguuuuucagcuuugcaaaauuacacuaacugcagagauaaugacauauauacauacuauggauuccaauauuuuggaggacuggcaauuugguuuaacaccuccuccgucugccaguuuacaggacacauauagauuuguuaccucccaggcuauuacuugccaaaaaacagcacccccuaaagaaaaggaagauccauuaaauaaauauacuuuuugggagguuaacuuaaaggaaaaguuuucugcagaucuugaucaguuuccuuugggacgaaaguuuuuauuacaaucaggccuuaaagcaaagcccagacuaaaacguucggccccuacuacccgugcaccauccaccaaacgcaaaaagguuaaaaaa

SEQ ID NO: 444 - RNA, 1524 nt, Human papillomavirus
auggcucuauggcguucuagugacaacaagguguaucuaccuccaccuucgguagcuaagguugucagcacugaugaguaugucacccguaccaguauuuucuaccacgcaggcaguuccagacuucuuacaguuggacauccauauuuuaaaguaccuaaaggugguaaugguagacaggauguuccuaaggugucugcauaucaauacagaguauuuaggguuaaguuaccugaucccaauaaauuuggccuuccagauaacacaguauaugauccuaacucucaacgcuuggucugggccuguguagguguugaaaucggucggggccaaccuuuagggguaggacucaguggucauccauuauauaauaaauuggaugacacugaaaacucucauguagcaucugcuguugauaccaaagauacacgugauaauguaucuguggauuauaaacaaacucagcuguguauuauuggcuguguaccugccauuggagaacacuggacaaagggcacugcuuguaagccuacuacugugguucagggcgauuguccuccacuagaauuaauaaauacaccaauugaagauggugauaugguagacacaggauauggggcuauggacuuuaaauuguugcaggauaacaaaagugaaguaccauuggauauuugucagucuauuuguaaauauccugauuauuuacaaaugucagcagaugcuuauggagacaguauguuuuuuuguuuaaggcgagaacagguuuuugccagacauuuuuggaauagaucugguacuaugggugaucaacuuccugaaucacuauauauuaaagguacugacauacgugccaacccaggcaguuauuuauauuccccuuccccaagugggucugugguuacuucugauucacaauuauuuaauaaaccauauuggcugcacaaggcucaggguuuaaacaaugguauauguuggcacaaucaauuguuuuuaacaguuguagauacuacucgcagcaccaaucuuucugugugugcuucuacuacuucuucuauuccuaauguauacacaccuaccaguuuuaaagaauaugccagacauguggaggaauuugauuugcaguuuauauuucagcuguguaaaauaacauuaacuacagagguaaugucauacauucauaauaugaauaccacuauuuuggaggauuggaauuuugguguuacaccaccuccuacugcuaguuuaguugacacauaccguuuuguucaaucugcugcuguaacuugucaaaaggacaccgcaccgccaguuaaacaggacccuuaugacaaacuaaaguuuuggccuguagaucuuaaggaaagguuuucugcagaucuugaucaguuuccuuugggacguaaauuuuuauugcaauuaggagcuagaccuaagcccacuauaggcccacgcaaacgugcagcgccugccccuaccucuaccccaucaccaaaacguguuaagcgucgcaagucuuccagaaaa

SEQ ID NO: 445 - RNA, 1515 nt, Human papillomavirus
auggcauuguggcgagcuagcgacaacaugguguauuugccuccccccucaguggcgaagguugucaauacagaugauuaugugacacgcacuggcauguauuacuaugcugguacaucuagguuauuaacuguaggccauccauauuuuaagguuccuaugucugggggccgcaagcagggcauuccuaaggugucugcauaucaauacagaguguuuaggguuaccuuaccugauccuaauaaauuuaguguuccugagucuacauuauauaauccagauacacagcgcaugguaugggccuguguugguguugaaauagguagggggcagccauugggcguuggccuuagugggcauccacuauauaauaggcuggaugauacugaaaauuccccguuuuccucuaauaaaaauccuaaagauaguagggacaauguugcaguggacuguaaacaaacacagcuguguauuauaggcuguguuccugcuauuggagagcacugggccaaagguaaaucuuguaagccuaccaauguacaacaaggggacugucccccauuggaauugguaaauacuccuauugaggauggcgauaugauugauacaggauauggugcuauggacuuugguacauuacaagaaacgaaaagcgagguaccuuuggauauaugucaaucuguuugcaaauauccugacuauuugcaaaugucugcagauguguauggagacaguauguuuuuuuguuuacguagggaacaguuauuugccaggcauuuuuggaauaggggaggcaugguaggggacacuauucccacugacauguauauuaagggcacugacauucgugaaacuccuaguaguuauguguaugcccccucgccuagcgggucuaugguguccucugacucccaguuauuuaacaagcccuauuggcugcacaaggcacagggacacaacaaugguauuuguuggcauaaucaauuauuucuuaccguuguggauacaacgcgcaguacuaauuuuacauuguccacuacuacagacucuacuguaccagcuguguaugauucuaauaaauuuaaggaauauguuaggcauguugaggaauaugauuugcaguuuauauuucaguuguguacuauaacauuauccacugacguaaugucauauauacauacuaugaauccugcuauuuuggaugauuggaauuuugguguugccccuccaccaucugcuagucuuguagauacauaccgcuaccuacaaucagcagcaauuacaugucaaaaggacgccccugcaccuguuaaaaaagaucccuaugauggucuuaacuuuuggaauguggauuuaaaggaaaaguuuaguucugaacuggaccaauucccauuaggacgcaaauuucuguuacaggcagguguucgcagacggcccaccauaggcccucguaaacgcacugccacugcagcuaccacaucuaccucuaaacacaaacguaaacgugugucaaaa

SEQ ID NO: 446 - RNA, 1509 nt, Human papillomavirus
auguggcgaccuacugaugcaaagguauaccugcccccugugucugugucuaagguuguaagcacagaugaauauguaacaagaacaaauauauauuauuaugcagguagcacacguuuguuggcugugggacacccauauuuuccuaucaaggauucucaaaaacguaaaaccauaguuccuaaaguuucagguuugcaauacaggguguuuaggcuucguuuaccagauccuaauaaauuuggauuuccagaugcauccuuuuauaauccugauaaggagcgccuaguaugggccuguucugguguggagguuggacguggacaacccuuagguauagguacuaguggcaauccauuuaugaauaaauuagaugauacugaaaaugcuccuaaauacauugcuggacaaaauacagaugguagagaauguaugucaguggauuauaaacaaacacaguuguguauuuuagguuguaggccucccuuaggggaacauugggguccaggcacgccauguacuucacaaacuguuaauacuggugauugucccccacuggaauuaaagaacaccccuauacaggauggugauaugauagauguuggcuuuggagccauggauuuuaaagcuuuacaagcaaauaaaagugauguaccuauugauauuucuaacacuaccuguaaauacccagauuauuuaggcauggcugcugaucccuauggugauuccaugugguuuuaucuucguagggaacaaauguuuguucgacacuuauuuaacagggcuggugauaccggugauaaaaucccagaugaccuaaugauuaaaggcacaggcaauacugcaacaccauccaguuguguuuuuuauccuacaccuagugguuccaugguuucuucagaugcacaguuguuuaauaaaccuuauugguugcaaaaggcacagggacaaaauaaugguauuuguuggcauaaucaauuauuuuuaacuguuguagauacuacuagaagcacuaauuuuucuguauguguagguacacaggcuaguagcucuacuacaacguaugccaacucuaauuuuaaggaauauuuaagacaugcagaagaguuugacuuacaguuuguuuuucaguuauguaaaauuaguuuaaccacugaggugaugacauauauccauucuaugaauucuacuauauuggaagaguggaauuuuggucuuaccccaccaccgucagguacuuuagaggaaacauauagauauguaacaucacaggcuauuaguugccaacguccucaaccuccuaaagaaacagaggacccauaugccaagcuauccuuuugggauguagaucuuaaggaaaaguuuucugcagaauuagaccaguuuccuuugggaagaaaauuuuuauuacaacuugguaugcgugcacguccuaaguuacaagcuucuaaacguucugcaucugcuaccacaagugccacaccuaagaaaaaacgugcuaaacguauu

SEQ ID NO: 447 - RNA, 1509 nt, Human papillomavirus
auggcuuuguggcguacuaaugacagcaaaguguauuuaccaccugcaccagugucacgcauugucaacacagaagaauauauaacccgcaccggcauauauuauuaugcaggcaguuccagacuuauuaccuuaggacauccauauuuuucaauacccaaaaccaauacacgugcugaaauaccuaagguaucugccuuucaguauaggguguuuaggguacaguuaccugaccccaacaaauuuggucuuccugauccuaauuuguuuaauccagacacagaucguuugguguggggauguguugguguugaaguagguaggggucagccguuagguguuggccuuaguggucauccuuuauuuaauaaguaugaugauacugaaaacucuagguuugccaauggcaacgaccaacaggauguuagggacaacauaucuguggacaacaaacaaacucaguuaugcauuauaggcugcgcuccuccuauuggggaacacugggccacagguaccacauguaaaaacguaccuguaccucagggugacuguccaccuuuggaacuugugucuacugucauugaggauggcgauaugguggacacugguuuuggggccauggauuuugcuaauuuacaagcuacuaaaucagauguuccauuggauauugcucagucuguguguaaauacccugauuacuuaaaaaugucagcagauacauauggcaauucuauguuuuuucauuuacgcagggagcaaauauuugcuaggcauuacuauaauaaggcuggugugguuggugaugccauuccagacaaggcuuauauuaaggguacuggugcuggccgcgacccuauuaguaguuauauuuauucagcuacucccagugguucuaugauaaccucugauucucagauuuuuaauaagccuuauugguugcaucgcgcccagggccacaauaauggcauuugcuggaauaaucagcuuuuuauuacuuguguugacacuacuaaaaguaccaauuuaaccauuagcacugcuguuacuccaucuguugcacaaacauuuacuccagcaaacuuuaagcaguacauuaggcauggggaagaauaugaauugcaauuuauauuucaauuguguaaaaucacuuuaacuacugaaauuauggcuuaccugcacaccauggauucuacaauuuuagaacaguggaauuuuggauuaacauugccccccuccgcuaguuuggaggaugccuaucgauuuguaaaaaaugcagcaacauccugucacaaggacaguccuccacaggcuaaagaagacccuuuggcaaaauauaaauuuuggaauguagaccuuaaggaacgcuuuucuuuggauuuggaucaguuugcauugggucgcaaguuuuuauuacaaaucggugcccaacgcaaacccagaccaggccuuaaaaggccugccccauccucuuccgcuuccucgucugccaaacguaaaaggguuaaaaaa

SEQ ID NO: 448 - RNA, 372 nt, Artificial Sequence
  Synthetic Polynucleotide
auggagacccccgcccagcugcuguuccugcugcugcuguggcugcccgacaccaccggccacggccccaaggccacccugcaggacaucgugcugcaccuggagccccagaacgagauccccguggaccugcugggccacggccagcugagcgacagcgaggaggagaacgacgagaucgacggcgugaaccaccagcaccugcccgccagaagagccgagccccagagacacaccaugcugugcaugugcugcaagugcgaggccagaaucaagcuggugguggagagcagcgccgacgaccugagagccuuccagcagcuguuccugaacacccugagcuucgugugccccuggugcgccagccagcag

SEQ ID NO: 449 - RNA, 315 nt, Artificial Sequence
  Synthetic Polynucleotide
augcacggccccaaggccacccugcaggacaucgugcugcaccuggagccccagaacgagauccccguggaccugcugggccacggccagcugagcgacagcgaggaggagaacgacgagaucgacggcgugaaccaccagcaccugcccgccagaagagccgagccccagagacacaccaugcugugcaugugcugcaagugcgaggccagaaucaagcuggugguggagagcagcgccgacgaccugagagccuuccagcagcuguuccugaacacccugagcuucgugugccccuggugcgccagccagcag

SEQ ID NO: 450 - RNA, 351 nt, Artificial Sequence
  Synthetic Polynucleotide
auggagacccccgcccagcugcuguuccugcugcugcuguggcugcccgacaccaccggccacggcgacacccccacccugcacgaguacaugcuggaccugcagcccgagaccaccgaccuguacggcuacggccagcugaacgacagcagcgaggaggaggacgagaucgacggccccgccggccaggccgagcccgacagagcccacuacaacaucgugaccuucugcugcaagugcgacagcacccugagacugugcgugcagagcacccacguggacaucagaacccuggaggaccugcugaugggcacccugggcaucgugugccccaucugcagccagaagccc

SEQ ID NO: 451 - RNA, 294 nt, Artificial Sequence
  Synthetic Polynucleotide
augcacggcgacacccccacccugcacgaguacaugcuggaccugcagcccgagaccaccgaccuguacggcuacggccagcugaacgacagcagcgaggaggaggacgagaucgacggccccgccggccaggccgagcccgacagagcccacuacaacaucgugaccuucugcugcaagugcgacagcacccugagacugugcgugcagagcacccacguggacaucagaacccuggaggaccugcugaugggcacccugggcaucgugugccccaucugcagccagaagccc

SEQ ID NO: 452 - RNA, 507 nt, Artificial Sequence
  Synthetic Polynucleotide
auggagacccccgcccagcugcuguuccugcugcugcuguggcugcccgacaccaccggcgccagauucgaggaccccaccagaagcggcuacaagcugcccgaccugugcaccgagcugaacaccagccugcaggacaucgagaucaccugcguguacugcaagaccgugcuggagcugaccgagguguucgagaaggaccuguucgugguguacagagacagcaucccccacgccgccugccacaagugcaucgacuucuacagcagaaucagagagcugagacacuacagcgacagcguguacggcgacacccuggagaagcugaccaacaccggccuguacaaccugcugaucagaugccugagaugccagaagccccugcugagacaccugaacgagaagagaagauuccacaacaucgccggccacuacagaggccagugccacagcugcugcaacagagccagacaggagagacugcagagaagaagagagacccaggug

SEQ ID NO: 453 - RNA, 450 nt, Artificial Sequence
  Synthetic Polynucleotide
auggccagauucgaggaccccaccagaagcggcuacaagcugcccgaccugugcaccgagcugaacaccagccugcaggacaucgagaucaccugcguguacugcaagaccgugcuggagcugaccgagguguucgagaaggaccuguucgugguguacagagacagcaucccccacgccgccugccacaagugcaucgacuucuacagcagaaucagagagcugagacacuacagcgacagcguguacggcgacacccuggagaagcugaccaacaccggccuguacaaccugcugaucagaugccugagaugccagaagccccugcugagacaccugaacgagaagagaagauuccacaacaucgccggccacuacagaggccagugccacagcugcugcaacagagccagacaggagagacugcagagaagaagagagacccaggug

SEQ ID NO: 454 - RNA, 507 nt, Artificial Sequence
  Synthetic Polynucleotide
auggagacccccgcccagcugcuguuccugcugcugcuguggcugcccgacaccaccggccaccagaagagaaccgccauguuccaggacccccaggagagcggcagaaagcugccccagcugugcaccgagcugcagaccaccauccacgacaucauccuggagugcguguacugcaagcagcagcugcugagaagagagguguacgacagagaccugugcaucguguacagagacggcaaccccuacgccgugugcgacaagugccugaaguucuacagcaagaucagcgaguacagacacuacugcuacagccuguacggcaccacccuggagcagcaguacaacaagccccugugcgaccugcugaucagaugcaucaacugccagaagccccugcagagacaccuggacaagaagcagagauuccacaacaucagaggcagauggaccggcagaugcaugagcugcugcagaagcagcagaaccagaagagagacccagcug

SEQ ID NO: 455 - RNA, 450 nt, Artificial Sequence
  Synthetic Polynucleotide
augcaccagaagagaaccgccauguuccaggacccccaggagagcggcagaaagcugccccagcugugcaccgagcugcagaccaccauccacgacaucauccuggagugcguguacugcaagcagcagcugcugagaagagagguguacgacagagaccugugcaucguguacagagacggcaaccccuacgccgugugcgacaagugccugaaguucuacagcaagaucagcgaguacagacacuacugcuacagccuguacggcaccacccuggagcagcaguacaacaagccccugugcgaccugcugaucagaugcaucaacugccagaagccccugcagagacaccuggacaagaagcagagauuccacaacaucagaggcagauggaccggcagaugcaugagcugcugcagaagcagcagaaccagaagagagacccagcug

SEQ ID NO: 456 - RNA, 315 nt, Human papillomavirus
augcauggaccuaaggcaacauugcaagacauuguauugcauuuagagccccaaaaugaaauuccgguugaccuucuaugucacgagcaauuaagcgacucagaggaagaaaacgaugaaauagauggaguuaaucaucaacauuuaccagcccgacgagccgaaccacaacgucacacaauguuguguauguguuguaagugugaagccagaauugagcuaguaguagaaagcucagcagacgaccuucgagcauuccagcagcuguuucugaacacccuguccuuuguguguccguggugugcaucccagcag

SEQ ID NO: 457 - RNA, 294 nt, Human papillomavirus
augcauggagauacaccuacauugcaugaauauauguuagauuugcaaccagagacaacugaucucuacuguuaugagcaauuaaaugacagcucagaggaggaggaugaaauagaugguccagcuggacaagcagaaccggacagagcccauuacaauauuguaaccuuuuguugcaagugugacucuacgcuucgguugugcguacaaagcacacacguagacauucguacuuuggaagaccuguuaaugggcacacuaggaauugugugccccaucuguucucagaaacca

SEQ ID NO: 458 - RNA, 474 nt, Human papillomavirus
auggcgcgcuuugaggauccaacacggcgacccuacaagcuaccugaucugugcacggaacugaacacuucacugcaagacauagaaauaaccuguguauauugcaagacaguauuggaacuuacagagguauuugaauuugcauuuaaagauuuauuugugguguauagagacaguauaccccaugcugcaugccauaaauguauagauuuuuauuccagaauuagagaauuaagacauuauucagacucuguguauggagacacauuggaaaaacuaacuaacacuggguuauacaauuuauuaauaaggugccugcggugccagaaaccguugaauccagcagaaaaacuuagacaccuuaaugaaaaacgacgauuucacaacauagcugggcacuauagaggccagugccauucgugcugcaaccgagcacgacaggaacgacuccaacgacgcagagaaacacaagua

SEQ ID NO: 459 - RNA, 474 nt, Human papillomavirus
augcaccaaaagagaacugcaauguuucaggacccacaggagcgacccagaaaguuaccacaguuaugcacagagcugcaaacaacuauacaugauauaauauuagaauguguguacugcaagcaacaguuacugcgacgugagguauaugacuuugcuuuucgggauuuaugcauaguauauagagaugggaauccauaugcuguaugugauaaauguuuaaaguuuuauucuaaaauuagugaguauagacauuauuguuauaguuuguauggaacaacauuagaacagcaauacaacaaaccguugugugauuuguuaauuagguguauuaacugucaaaagccacuguguccugaagaaaagcaaagacaucuggacaaaaagcaaagauuccauaauauaaggggucgguggaccggucgauguaugucuuguugcagaucaucaagaacacguagagaaacccagcug

SEQ ID NO: 460 - RNA, 423 nt, Human papillomavirus
auguggcuucaaaaucucuuguuucuuggaaucgucguguacagccugucagccccaacuagaucgccuaucacugugacgcgcccguggaagcacguggaagccaucaaggaggcucugaaucugcucgacgauaugccagugacccugaacgaggaagucgaagugguguccaacgaauuuuccuucaaaaaguugaccuguguucagacccggcugaagauuuucgagcagggccucaggggaaacuucaccaaacugaagggugcacugaacaugaccgccagcuacuaccagaccuauugcccuccgacuccggaaacugauugcgagacucaagucaccaccuacgcggacuucaucgacucgcucaagacguuccugacugacauccccuucgagugcaagaagccggggcagaaa

SEQ ID NO: 461 - RNA, 429 nt, Human papillomavirus
auguggcuacagucucuccugcuccugggaaccguggcuugcagcauaucagcgccugccaggagccccagcccaucuacccagccaugggagcacguaaacgccauacaggaagcccggcggcugcuuaaucuaucccgcgauacagcagccgaaaugaacgaaaccguggaggucaucagugagauguuugaucuacaagagccuacuugcuuacaaacccgccuagagcuuuacaagcaaggccuccggggcucucucacaaagcugaaagguccauuaacuaugauggccucccacuauaaacagcacugcccaccuacaccagagaccuccugugccacccagauuauaaccuucgaaagcuuuaaggagaauuuaaaggauuuccuccuggucauccccuucgacugcugggaaccaguccag

SEQ ID NO: 462 - protein, 13 aa, Salmonella typhimurium
LQRVRELAVQSAN

SEQ ID NO: 463 - DNA, 450 bp, Artificial Sequence
  Synthetic Polynucleotide
atgcaccagaagagaaccgccatgttccaggacccccaggagagcggcagaaagctgccccagctgtgcaccgagctgcagaccaccatccacgacatcatcctggagtgcgtgtactgcaagcagcagctgctgagaagagaggtgtacgacagagacctgtgcatcgtgtacagagacggcaacccctacgccgtgtgcgacaagtgcctgaagttctacagcaagatcagcgagtacagacactactgctacagcctgtacggcaccaccctggagcagcagtacaacaagcccctgtgcgacctgctgatcagatgcatcaactgccagaagcccctgcagagacacctggacaagaagcagagattccacaacatcagaggcagatggaccggcagatgcatgagctgctgcagaagcagcagaaccagaagagagacccagctg

What is claimed is:

1. A human papillomavirus (HPV) vaccine, comprising: a messenger ribonucleic acid (mRNA) polynucleotide comprising an open reading frame encoding a HPV protein selected from HPV E1 protein, HPV E2 protein, HPV E4 protein, HPV E5 protein, HPV E6 protein, HPV E7 protein, HPV L1 protein, and HPV L2 protein formulated in a lipid nanoparticle that comprises a molar ratio of 20-60% cationic lipid, 0.5-15% PEG-modified lipid, 25-55% sterol, and 5-25% non-cationic lipid, wherein the mRNA polynucleotide is not a self-replicating RNA, and the cationic lipid comprises a Compound 25 lipid:

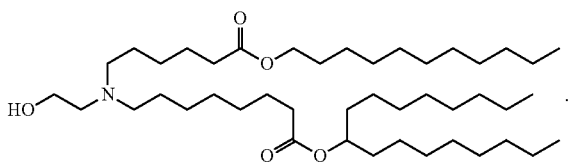 [SMILES: CCCCCCCCCCCOC(=O)CCCCCN(CCO)CCCCCCCC(=O)OC(CCCCCCCC)CCCCCCCC]

2. The vaccine of claim 1, wherein the HPV protein is a HPV serotype selected from HPV serotypes 6, 11, 16, 18, 31, 33, 35, 39, 45, 51, 52, 56, 58, 59, 68, 73 and 82.

3. The vaccine of claim 1, wherein the HPV protein comprises an amino acid sequence of any one of SEQ ID NO: 31-59, the mRNA polynucleotide is encoded by a nucleic acid sequence of any one of SEQ ID NO: 1-28 or 463, and/or wherein the mRNA polynucleotide comprises a nucleic acid sequence of any one of SEQ ID NO: 431-459.

4. The vaccine of claim 1, wherein the mRNA polynucleotide has less than 80% identity to wild-type mRNA sequence.

5. The vaccine of claim 1, wherein the mRNA polynucleotide has at least 80% identity to wild-type mRNA sequence, but does not include wild-type mRNA sequence.

6. The vaccine of claim 1, wherein the mRNA polynucleotide comprises at least one chemical modification.

7. The vaccine of claim 6, wherein the chemical modification is selected from pseudouridine, N1-methylpseudouridine, N1-ethylpseudouridine, 2-thiouridine, 4'-thiouridine, 5-methylcytosine, 5-methyluridine, 2-thio-1-methyl-1-deaza-pseudouridine, 2-thio-1-methyl-pseudouridine, 2-thio-5-aza-uridine, 2-thio-dihydropseudouridine, 2-thio-dihydrouridine, 2-thio-pseudouridine, 4-methoxy-2-thio-pseudouridine, 4-methoxy-pseudouridine, 4-thio-1-methyl-pseudouridine, 4-thio-pseudouridine, 5-aza-uridine, dihydropseudouridine, 5-methoxyuridine and 2'-O-methyl uridine.

8. The vaccine of claim 6, wherein the chemical modification is in the carbon 5-position of the uracil.

9. The vaccine of claim 7, wherein the chemical modification is a N1-methylpseudouridine or N1-ethylpseudouridine.

10. The vaccine of claim 6, wherein at least 80% of the uracil in the open reading frame has a chemical modification.

11. The vaccine of claim 10, wherein at least 90% of the uracil in the open reading frame has a chemical modification.

12. The vaccine of claim 11, wherein 100% of the uracil in the open reading frame has a chemical modification.

13. The vaccine of claim 1, wherein the mRNA polynucleotide further encodes a 5' terminal cap.

14. The vaccine of claim 13, wherein the 5' terminal cap is 7mG(5')ppp(5')NlmpNp.

15. The vaccine of claim 1, wherein the non-cationic lipid is a neutral lipid and the sterol is a cholesterol.

16. The vaccine of claim 1, wherein the open reading frame is codon-optimized.

17. The vaccine of claim 1, wherein the vaccine is multivalent.

18. The vaccine of claim 1 formulated in an effective amount to produce an antigen-specific immune response.

19. A method of inducing an immune response in a subject, the method comprising administering to the subject the vaccine of claim 1 in an amount effective to produce an antigen-specific immune response in the subject.

* * * * *